United States Patent 7,745,391 (HUMAN THROMBOSPONDIN POLYPEPTIDE) - sequence listing, part 120

SEQ ID NO: 343773 - DNA, 928 bp, Homo sapiens
cagttttatggagccccaaatgctctgaaaacaattagtaacctggaagttgtcagcccaaaggaaagaaaaatcaattgtatcttgaaattttacctatggctctttggcctggcttctttgttcattataagttagtgtgttccttcaggaaacaatgccttaataccatagaacatgggggccttaatagttgctaacattaaaaaagcaaacagaatgattgagggatccttatgaaaacaaaatggtgaattggacatgcagaacctaccatttccttcccctgtttgcaatttttgtggggaggggaggatgttagtatttacaaaagatgattttaagaacttccaagagatgagtttaagaattccatagagtattagttgttcactgtgtaattaatccttccggagagtcttttttttttttttttaaagaaacttttgggtgggttttgttttttattagttaccctaggggtatgttaccctggggtatgaagggaggtgaagataacggaggggggagaaaaaaaaaagaagaaaaaaggagcctaaaatggggaataattgaaatggaacagggggtgtgaggctggttcctcagtccccattccaaacggaggatagaagctgtgtatttatgtgacctggcagatctctggggccataacactgaaaagtgaaagaacctggtgggcagctatctttggctactgataaccagcagaaatgtctgttaattctgattttctcaatttgaagggatcagctacactgttaaattttggaaagccactacctacttccatcaagtaacttaggtttcgaaatatgggttcaacgcacctcccttattaaatgcaagtaggtatatatgataaggagggtgcaagatgtcttgggtgatggcattggcctgccaa

SEQ ID NO: 343774 - DNA, 2703 bp, Homo sapiens
cagttttatggagccccaaatgctctgaaaacaattagtaacctggaagttgtcagcccaaaggaaagaaaaatcaattgtatcttgaaattttacctatggctctttggcctggcttctttgttcattataagttagtgtgttccttcaggaaacaatgccttaataccatagaacatgggggccttaatagttgctaacattaaaaaagcaaacagaatgattgagggatccttatgaaaacaaaatggtgaattggacatgcagaacctaccatttccttcccctgtttgcaatttttgtggggaggggaggatgttagtatttacaaaagatgattttaagaacttccaagagatgagtttaagaattccatagagtattagttgttcactgtgtaattaatccttccggagagtcttttttttttttttttaaagaaacttttgggtgggttttgttttttattagttaccctaggggtatgttaccctggggtatgaagggaggtgaagataacggaggggggagaaaaaaaaaagaagaaaaaaggagcctaaaatggggaataattgaaatggaacagggggtgtgaggctggttcctcagtccccattccaaacggaggatagaagctgtgtatttatgtgacctggcagatctctggggccataacactgaaaagtgaaagaacctggtgggcagctatctttggctactgataaccagcagaaatgtctgttaattctgattttctcaatttgaagggatcagctacactgttaaattttggaaagccactacctacttccatcaagtaacttaggtttcgaaatatgggttcaacgcacctcccttattcaaaatgtcaaaatagattattataatgtataaagtaagaattgacaaaatatgattcttgggttgattggtcatttagaaactagccaaaagtgagacttttaatgtagaacatttttcagaaatgggtacaaagaaaaatgcatattactgtatatttcagagtgtttatgtgaaccttgtatttaattgagagtcccatgtacgttctgcagcctttttgctgcttctatcatctgaagtttgtgtagtacaaataaggcctttgggattcttaatgacatttatgttaaaatgttctcttctctttaaacaccgttttccaatccacctgtcagggagtccaaatcgtgtctgtgttgatgatgctatactttgtagctagaaaaacaattttagtgttgtgggctctgtattcagacttcctttttacaagaccgatgggcagtgatagattattttatcatatttaatgcatgggaaatagtgtgctgaggaagctattaaaagtataactcagtgaattgggtctgagttttaaatgagatatttcaaaattggcttgccactgtaaaagcgactaaataataatatgatactgttctttatgatcttgtcatgtttcactgatatgtttggggtcttcactatgtaaaaaatgtcaaaattgtaatgagcaagcatgtacaagtagtcgtaaatcaaaggttttaaacaggactgcattttcaattaggaaaagctgtttggcagatagcatccaatgcaaaaacagaaatatcgtaacgttctgcttagtgggcaagataagataggaaagacatgctcaaagaggcaaaagaatcattgctatcattcattctacactagtttgaagaagtttttgtacatcagagcacttccttcagcacacttttttgccttcagatttcattttttataaaatgagaagactaatgataaactgtagaaatcaaaatttattgagaaatctgtttctcctaacagatagtaaccctgccatgatatactacttcaacaatgttataaaagttatgtgataatatacattttaacctgggatttctaaattgctttaacaaatgctaatcctgagagttgccctgcaggactcaaaagggaaaggttttgggacgtggcagaaccctgcagggacatggaattaaggccattgcaatgtatcatctttgtagcattgtcatcactcctaagctgccttcacagttttagtacactaagatgaggaaatcgaaaatgggcagagaaagctcatactgtataattgaagacagtgacagagaacgtgtcagttatgccaaaactcttttgatttctgttccaggatttccaacaagaggggaaaggaatgacttgggagggtgggaaagacattaggagttgtttttattttttaccttggaagctttagctaccaatccagtaccctcctaactagaatgtatacacatcagcaggactgactgactacttcattagagatatactgtactcattgggggccttgggggtactgctgttcttatgtgggattttaatgttgtaatgtattgcatcttaatgtattgaattcattttgttgtactatattggttggcattttattaaaataaattgtattgtatcatatttgtatgttttaagagaaaataatataaaatacaatatttgtactattatatagtgcaaaaactacaaatctgtgcctctgcctcttgaattaattctttggttgcttgcatttgggaagggaatggagaaaggaaagaaccaataaagctttcaaagttcaagaaaaaaacc

SEQ ID NO: 343775 - DNA, 2583 bp, Homo sapiens
cagttttatggagccccaaatgctctgaaaacaattagtaacctggaagttgtcagcccaaaggaaagaaaaatcaattgtatcttgaaattttacctatggctctttggcctggcttctttgttcattataagttagtgtgttccttcaggaaacaatgccttaataccatagaacatgggggccttaatagttgctaacattaaaaaagcaaacagaatgattgagggatccttatgaaaacaaaatggtgaattggacatgcagaacctaccatttccttcccctgtttgcaatttttgtggggaggggaggatgttagtatttacaaaagatgattttaagaacttccaagagatgagtttaagaattccatagagtattagttgttcactgtgtaattaatccttccggagagtcttttttttttttttttaaagaaacttttgggtgggttttgttttttattagttaccctaggggtatgttaccctggggtatgaagggaggtgaagataacggaggggggagaaaaaaaaaagaagaaaaaaggagcctaaaatggggaataattgaaatggaacagggggtgtgaggctggttcctcagtccccattccaaacggaggatagaagctgtgtatttatgtgacctggcagatctctggggccataacactgaaaagtgaaagaacctggtgggcagctatctttggctactgataaccagcagaaatgtctgttaattctgattttctcaatttgaagggatcagctacactgttaaattttggaaagccactacctacttccatcaagtaacttaggtttcgaaatatgggttcaacgcacctcccttattcaaaatgtcaaaatagattattataatgtataaagtaagaattgacaaaatatgattcttgggttgattggtcatttagaaactagccaaaagtgagacttttaatgtagaacatttttcagaaatgggtacaaagaaaaatgcatattactgtatatttcagagtgtttatgtgaaccttgtatttaattgagagtcccatgtacgttctgcagcctttttgctgcttctatcatctgaagtttgtgtagtacaaataaggcctttgggattcttaatgacatttatgttaaaatgttctcttctctttaaacaccgttttccaatccacctgtcagggagtccaaatcgtgtctgtgttgatgatgctatactttgtagctagaaaaacaattttagtgttgtgggctctgtattcagacttcctttttacaagaccgatgggcagtgatagattattttatcatatttaatgcatgggaaatagtgtgctgaggaagctattaaaagtataactcagtgaattgggtctgagttttaaatgagatatttcaaaattggcttgccactgtaaaagcgactaaataataatatgatactgttctttatgatcttgtcatgtttcactgatatgtttggggtcttcactatgtaaaaaatgtcaaaattgtaatgagcaagcatgtacaagtagtcgtaaatcaaaggttttaaacaggactgcattttcaattaggaaaagctgtttggcagatagcatccaatgcaaaaacagaaatatcgtaacgttctgcttagtgggcaagataagataggaaagacatgctcaaagaggcaaaagaatcattgctatcattcattctacactagtttgaagaagtttttgtacatcagagcacttccttcagcacacttttttgccttcagatttcattttttataaaatgagaagactaatgataaactgtagaaatcaaaatttattgagaaatctgtttctcctaacagatagtaaccctgccatgatatactacttcaacaatgttataaaagttatgtgataatatacattttaacctgggatttctaaattgctttaacaaatgctaatcctgagagttgccctgcaggactcaaaagggaaaggttttgggacgtggcagaaccctgcagggacatggaattaaggccattgcaatgtatcatctttgtagcattgtcatcactcctaagctgccttcacagttttagtacactaagatgaggaaatcgaaaatgggcagagaaagctcatactgtataattgaagacagtgacagagaacgtgtcagttatgccaaaactcttttgatttctgttccaggatttccaacaagaggggaaaggaatgacttgggagggtgggaaagacattaggagttgtttttattttttaccttggaagctttagctaccaatccagtaccctcctaactagaatgtatacacatcagcaggactgactgactacttcattagagatatactgtactcattgggggccttgggggtactgctgttcttatgtgggattttaatgttgtaatgtattgcatcttaatgtattgaattcattttgttgtactatattggttggcattttattaaaataaattgtattgtatcatatttgtatgttttaagagaaaataatataaaatacaatatttgtactattatata

SEQ ID NO: 343776 - DNA, 1240 bp, Homo sapiens
tctcatcaacaaccgactaatcaccaccctactatgactaatcaaactaacctctatacaaatgataaccatacactacacttaaggacgaacctgatctcttatactagtatccttaatcatttttattgccactactaatttctctcggacctatgcattggtccgagagaaattagggattgccacacggtcttctgcaatgtttgaactaatttacactcccaccaacagcataaaatcattgctatcattcattctacactagtttgaagaagtttttgtacatcagagcacttccttcagcacacttttttgccttcagatttcattttttataaaatgagaagactaatgataaactgtagaaatcaaaatttattgagaaatctgtttctcctaacagatagtaaccctgccatgatatactacttcaacaatgttataaaagttatgtgataatatacattttaacctgggatttctaaattgctttaacaaatgctaatcctgagagttgccctgcaggactcaaaagggaaaggttttgggacgtggcagaaccctgcagggacatggaattaaggccattgcaatgtatcatctttgtagcattgtcatcactcctaagctgccttcacagttttagtacactaagatgaggaaatcgaaaatgggcagagaaagctcatactgtataattgaagacagtgacagagaacgtgtcagttatgccaaaactcttttgatttctgttccaggatttccaacaagaggggaaaggaatgacttgggagggtgggaaagacattaggagttgtttttattttttaccttggaagctttagctaccaatccagtaccctcctaactagaatgtatacacatcagcaggactgactgactacttcattagagatatactgtactcattgggggccttgggggtactgctgttcttatgtgggattttaatgttgtaatgtattgcatcttaatgtattgaattcattttgttgtactatattggttggcattttattaaaataaattgtattgtatcatatttgtatgttttaagagaaaataatataaaatacaatatttgtactattatatagtgcaaaaactacaaatctgtgcctctgcctcttgaattaattctttggttgcttgcatttgggaagggaatggagaaaggaaagaaccaataaagctttcaaagttcaagaaaaaaacc

SEQ ID NO: 343777 - DNA, 885 bp, Homo sapiens
agtcattgccatgtccccatttactgagaactcaacgtctgtcacttgtggactcacccttggctacacccagtggctgcctttgggcccaggtgcccccatcagcagcacagcgtgagtgagtggtacagaccagccgccccctccgtgtgtttactgatgcagcctcagcgtgggggccgtggcgcgctcgtgtgacacgcgtttgccctctgcactaggcaacgtgaagccggaagatgtgaagagagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttc

SEQ ID NO: 343778 - DNA, 2141 bp, Homo sapiens
agcggaagtgacgactgaagcggggcggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagagacaccaccatgtatgctgtgtctgctgatagcaaaggcttggacacggtggttgccttactggctgatgtggttctgcagccccggctaacagatgaagaagtcgagatgacgcggatggcggtccagtttgagctggaggacctgaacctgcggcctgacccagagccacttctcaccgagatgattcatgaagcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaagctagaaagagacatgtccaatgtcagcctgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgcaacgtgaagccggaagatgtgaagagagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttcaatttcccacacaacatacacacgacagacac

SEQ ID NO: 343779 - DNA, 1979 bp, Homo sapiens
agcggaagtgacgactgaagcggggcggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagagacaccaccatgtatgctgtgtctgctgatagcaaaggcttggacacggtggttgccttactggctgatgtggttctgcagccccggctaacagatgaagaagtcgagatgacgcggatggcggtccagtttgagctggaggacctgaacctgcggcctgacccagagccacttctcaccgagatgattcatgaagcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgcaacgtgaagccggaagatgtgaagagagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttc

SEQ ID NO: 343780 - DNA, 2668 bp, Homo sapiens
agcggaagtgacgactgaagcggggcggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagagacaccaccatgtatgctgtgtctgctgatagcaaaggcttggacacggtggttgccttactggctgatgtggttctgcagccccggctaacagatgaagaagtcgagatgacgcggatggcggtccagtttgagctggaggacctgaacctgcggcctgacccagagccacttctcaccgagatgattcatgaagtaaaatgtcaaactcgagaatgcccccgcatctcgaacagtggtcctcgggacaccaggggtggtggggagggtgcctccgtgatgttgtccttgcaggttatggatatatacagaacatttttttgttttttgagatgaggtttctccacattgcctacgctggtcttgcactcctgggctcagctcaggtgatcctcctgcctctgcctcccaagtagctgggattacaggcgtgagtcaccgcactcagcttagaacattcttgatttctgagtctgctgtttatacaatgttcgtattttccagtttttatagtaactaggtctttactactaaacacaattaatcttaggctttttgtgaatttgtattctggagaggcagattttactctttataaatacgcacgcagctgctattgccagagtgcaagtaaaatatcagcttgcgtcggattttcccagggctggctgcagatgggcgctggtgctgcttgttggaggaagcctggtcatgctgtcttcagtcacctgtgtctgtggctcttccccattaggcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaagctagaaagagacatgtccaatgtcagcctgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgcaacgtgaagccggaagatgtgaagagagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttc

SEQ ID NO: 343781 - DNA, 2399 bp, Homo sapiens
agcggaagtgacgactgaagcggggcggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaagtaagtactgttgtgttgtcgtgggtggtcccgcagttttaacatgcacatgctttagttgactgttagttgtaattagcatgccaattatgaattgtaccctgagtggaaacaaagtgtacgatttcataaatgttgagctacacatatacctgtgaaaccatcagcacaatcaccctcatgtaattaaatctgattatcatgtcatattgacatcttaaaatgtttctcttgattaaatcttattttgaatatctgatgtaacctgtcaattttctttttactactagttcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagagacaccaccatgtatgctgtgtctgctgatagcaaaggcttggacacggtggttgccttactggctgatgtggttctgcagccccggctaacagatgaagaagtcgagatgacgcggatggcggtccagtttgagctggaggacctgaacctgcggcctgacccagagccacttctcaccgagatgattcatgaagcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaagctagaaagagacatgtccaatgtcagcctgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgcaacgtgaagccggaagatgtgaagagagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttc

SEQ ID NO: 343782 - DNA, 2014 bp, Homo sapiens
agcggaagtgacgactgaagcggggcggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagatgaagaagtcgagatgacgcggatggcggtccagtttgagctggaggacctgaacctgcggcctgacccagagccacttctcaccgagatgattcatgaagcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaagctagaaagagacatgtccaatgtcagcctgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgcaacgtgaagccggaagatgtgaagagagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttc

SEQ ID NO: 343783 - DNA, 2060 bp, Homo sapiens
agcggaagtgacgactgaagcggggcggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagagacaccaccatgtatgctgtgtctgctgatagcaaaggcttggacacggtggttgccttactggctgatgtggttctgcagccccggctaacagatgaagaagtcgagatgacgcggatggcggtccagtttgagctggaggacctgaacctgcggcctgacccagagccacttctcaccgagatgattcatgaaaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaagctagaaagagacatgtccaatgtcagcctgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgcaacgtgaagccggaagatgtgaagagagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttc

SEQ ID NO: 343784 - DNA, 1600 bp, Homo sapiens
agcggaagtgacgactgaagcggggcggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagagacaccaccatgtatgctgtgtctgctgatagcaaaggcttggacacggtggttgccttactggctgatgtggttctgcagccccggctaacagatgaagaagtcgagatgacgcggatggcggtccagtttgagctggaggacctgaacctgcggcctgacccagagccacttctcaccgagatgattcatgaagcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaagctagaaagagacatgtccaatgtcagcctgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatcctgcggagtgtgctgtatgcttgtgtgtgtgctgtgctcgtgtgtgtgctgtgttcatgcgtctgctgtgtgtcctcccgtgtgtagctgtcggggatgcataatagtatcgagtgctctacggaggatgggaattgagatgtaagatttggggtt

SEQ ID NO: 343785 - DNA, 1538 bp, Homo sapiens
agcggaagtgacgactgaagcggggcggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagagacaccaccatgtatgctgtgtctgctgatagcaaaggcttggacacggtggttgccttactggctgatgtggttctgcagccccggctaacagatgaagaagtcgagatgacgcggatggcggtccagtttgagctggaggacctgaacctgcggcctgacccagagccacttctcaccgagatgattcatgaagtaaaatgtcaaactcgagaatgcccccgcatctcgaacagtggtcctcgggacaccaggggtggtggggagggtgcctccgtgatgttgtccttgcaggttatggatatatacagaacatttttttgttttttgagatgaggtttctccacattgcctacgctggtcttgcactcctgggctcagctcaggtgatcctcctgcctctgcctcccaagtagctgggattacaggcgtgagtcaccgcactcagcttagaacattcttgatttctgagtctgctgtttatacaatgttcgtattttccagtttttatagtaactaggtctttactactaaacacaattaatcttaggctttttgtgaatttgtattctggagaggcagattttactctttataaatacgcacgcagctgctattgccagagtgcaagtaaaatatcagcttgcgtcggattttcccagggctggctgcagatgggcgctggtgctgcttgttggaggaagcctggtcatgctgtcttcagtcacctgtgtctgtggctcttccccattaggcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaagcgtgaagtaccggttttcgccacaggatcctctaaacaccgcaga

SEQ ID NO: 343786 - DNA, 440 bp, Homo sapiens
  misc_feature (32)..(32): n is a, c, g, or t
  misc_feature (58)..(58): n is a, c, g, or t
tactggccttacgcgcggattcggtgcgtgtntgtcaccacctccttcagcttcttcntcacctgtcgctcccgctctgacatgccttcgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttc

SEQ ID NO: 343787 - DNA, 522 bp, Homo sapiens
agcggaagtgacgactgaagcggggcggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaaggtacaccagcttttgtgtacaaactgactttgggtccttgggaactga

SEQ ID NO: 343788 - DNA, 526 bp, Homo sapiens
agcggaagtgacgactgaagcggggcggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcggtcagtacccagttttgtaattttttagactatacttttgaaggatgtttgagatttttcttgtctataatggttattttaataaattatcaagttgctaagttaatgttaataaaagacttttaagttaaaaga

SEQ ID NO: 343789 - DNA, 2109 bp, Homo sapiens
agcggaagtgacgactgaagcggggcggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagagacaccaccatgtatgctgtgtctgctgatagcaaaggcttggacacggtggttgccttactggctgatgtggttctgcagccccggctaacagatgaagaagtcgagatgacgcggatggcggtccagtttgagctggaggacctgaacctgcggcctgacccagagccacttctcaccgagatgattcatgaagcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaagctagaaagagacatgtccaatgtcagcctgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgcaacgtgaagccggaagatgtgaagagagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttc

SEQ ID NO: 343790 - DNA, 2112 bp, Homo sapiens
agcggaagtgacgactgaagcggggcggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagagacaccaccatgtatgctgtgtctgctgatagcaaaggcttggacacggtggttgccttactggctgatgtggttctgcagccccggctaacagatgaagaagtcgagatgacgcggatggcggtccagtttgagctggaggacctgaacctgcggcctgacccagagccacttctcaccgagatgattcatgaagcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaagctagaaagagacatgtccaatgtcagcctgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgcaacgtgaagccggaagatgtgaagagagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgataaccttggtgtataatggctgttctcctttttttctttt

SEQ ID NO: 343791 - DNA, 2573 bp, Homo sapiens
agcggaagtgacgactgaagcggggcggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagatgaagaagtcgagatgacgcggatggcggtccagtttgagctggaggacctgaacctgcggcctgacccagagccacttctcaccgagatgattcatgaagtaaaatgtcaaactcgagaatgcccccgcatctcgaacagtggtcctcgggacaccaggggtggtggggagggtgcctccgtgatgttgtccttgcaggttatggatatatacagaacatttttttgttttttgagatgaggtttctccacattgcctacgctggtcttgcactcctgggctcagctcaggtgatcctcctgcctctgcctcccaagtagctgggattacaggcgtgagtcaccgcactcagcttagaacattcttgatttctgagtctgctgtttatacaatgttcgtattttccagtttttatagtaactaggtctttactactaaacacaattaatcttaggctttttgtgaatttgtattctggagaggcagattttactctttataaatacgcacgcagctgctattgccagagtgcaagtaaaatatcagcttgcgtcggattttcccagggctggctgcagatgggcgctggtgctgcttgttggaggaagcctggtcatgctgtcttcagtcacctgtgtctgtggctcttccccattaggcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaagctagaaagagacatgtccaatgtcagcctgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgcaacgtgaagccggaagatgtgaagagagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttc

SEQ ID NO: 343792 - DNA, 1845 bp, Homo sapiens
agcggaagtgacgactgaagcggggcggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagagacaccaccatgtatgctgtgtctgctgatagcaaaggcttggacacggtggttgccttactggctgatgtggttctgcagccccggctaacagatgaagaagtcgagatgacgcggatggcggtccagtttgagctggaggacctgaacctgcggcctgacccagagccacttctcaccgagatgattcatgaagcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaagctagaaagagacatgtccaatgtcagcctgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgtgagtaccgcaggggtagtgaggggctgccgcaggcctcggccaggctcagaggaggccgtctcgccctcccgcaggccgtggtgggcctgtggtatgtccatcacacccagaatctggggccttcaccagttgtcctcagcaggggcggccaagggcagggtcgtggggtcgcagacctggtctcacttcccggccccaccatgcacctgctgcctccttggcaggtgaccccaccctctgcacccctgggaggggctgtcactactgcccagagttgttaaagagcactcaagttagtaggcgagaagggctcagtagaggactgctacattgtacgtggagtagcagtggctcggaatgccgctgtaccgttgctggctctcgggcaggagtctca

SEQ ID NO: 343793 - DNA, 1036 bp, Homo sapiens
ggtttcactctgttagccaggatggtctcaatctcctgacctcgtgatccgcctgcctcagcctcccaaagagctgggattacaggcgggagccactgcgcccggctgcccttccctttcttatgttcagctttgggcacagagatggcgttttgccattgctcgagtggggggtggaaggtggcacggggcgggtgtgtgctcacctgactggaccctggccccaggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgcaacgtgaagccggaagatgtgaagagagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttc

SEQ ID NO: 343794 - DNA, 1013 bp, Homo sapiens
agcggaagtgacgactgaagcggggcggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagagacaccaccatgtatgctgtgtctgctgatagcaaaggcttggacacggtggttgccttactggctgatgtggttctgcagccccggctaacagatgaagaagtcgagatgacgcggatggcggtccagtttgagctggaggacctgaacctgcggcctgacccagagccacttctcaccgagatgattcatgaagtaaaatgtcaaactcgagaatgcccccgcatctcgaacagtggtcctcgggacaccaggggtggtggggagggtgcctccgtgatgttgtccttgcaggttatggatatatacagaacatttttttgttttttgagatgaggtttctccacattgcctacgctggtcttgcactctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttc

SEQ ID NO: 343795 - DNA, 816 bp, Homo sapiens
agcggaagtgacgactgaagcggggcggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaagtaagtactgttgtgttgtcgtgggtggtcccgcagttttaacatgcacatgctttagttgactgttagttgtaattagcatgccaattatgaattgtaccctgagtggaaacaaagtgtacgatttcataaatgttgagctacacatatacctgtgaaaccatcagcacaatcaccctcatgtaattaaatctgattatcatgtcatattgacatcttaaaatgtttctcttgattaaatcttattttgaatatctgatgtaacctgtcaattttctttttactactagttcttatcaattcaggatcgagatatgaagcgaaataccttagtggaattgctcactttttggaaaaattggcattttcggtcagtacccagttttgtaattttttagactatacttttgaaggatgtttgagatttttcttgtctataatggttattttaataaattatcaagttgctaagttaatgttaataaaagacttttaagttaaaaga

SEQ ID NO: 343796 - DNA, 528 bp, Homo sapiens
gactgcagtcgactctaaagatccccccctcagattacctcaatcattcaataagtgtttgtaatagtggaaaagaaaccagaataaacacaaatatttaacaacagggactgaaaaaataattaatagaaaattgtattttatgactacttgacctcatagcagccatcaacataactaactccttgcagtccttcttggtcaaccctggctccgcttttgtacaacttacaaatgctgaatcacctggtcccacatcacagttgcaaggcccctttctattctcaaatcaaatgccctggctttaggcagcagctatatgctataatctaccttatgtctatctccagctgtgcctggaattagctgagtaaccaaatgactacttgacctctctacgattgtctaaaagacagttcaattttcaagtacaaaataaaactcttggctggcacagtggctcgagcctataatcccagcactttgggaggcccaggcgggtgcatcacttgagtaatccgtgatggt

SEQ ID NO: 343797 - DNA, 519 bp, Homo sapiens
cttgatgtaccagccccgcacaccctacggtctctgactggagaaaagcctgtacgagtggaaaagaaaccagaataaacacaaatatttaacaacagggactgaaaaaataattaatagaaaattgtattttatgactacttgacctcatagcagccatcaacataactaactccttgcagtccttcttggtcaaccctggctccgcttttgtacaacttacaaatgctgaatcacctggtcccacatcacagttgcaaggcccctttctattctcaaatcaaatgccctggctttaggcagcagctatatgctataatctaccttatgtctatctccagctgtgcctggaattagctgagtaaccaaatgactacttgacctctctacgattgtctaaaagacagttcaattttcaagtacaaaataaaactcttggctggcacagtggctcgagcctataatcccagcactttgggaggcccaggcgggtgcatcacttgagtaatccgtgatggt

SEQ ID NO: 343798 - DNA, 454 bp, Homo sapiens
ccattaatcaccacttactatacacctataggatcagtaaagttaatccgtaaagagattgaatttcatgactacatcagctcgtatccaccctcaacactgcccgtccctttcaaacgttattactaaaaccctcctcgccgttttgtacaacttacaaatgctgaatcacctggtcccacatcacagttgcaaggcccctttctattctcaaatcaaatgccctggctttaggcagcagctatatgctataatctaccttatgtctatctccagctgtgcctggaattagctgagtaaccaaatgactacttgacctctctacgattgtctaaaagacagttcaattttcaagtacaaaataaaactcttggctggcacagtggctcgagcctataatcccagcactttgggaggcccaggcgggtgcatcacttgagtaatccgtgatggt

SEQ ID NO: 343799 - DNA, 759 bp, Homo sapiens
tccaatacagtgccctggttttcctctaacatctctcaagagctctaccttttgtccctgactccaaatgatgttttggggttttttgcttttctttcccctgcaagtgttctgcattacacccttttctcactctgtaccctttcatccgctagggtcttaactactcctctcagctgtgattctcatccttaagtcctggtctttcctcaaatattgctacctgcctgttggacatatttcactgtatgttctgctcactcctccagctcaacatttctaaactgtagtcactgtccccaccagaccttcttcttttgacctgcccttttccttggtatcaccatttccaaaagcatgaaactttgggtgactcccattcctactactgtcaggaatcaacctaacaccatatttttctatcacactccttagaggcttgtactactcttcatctggattataagtcccaaattatttaggctccaaaatactctactcactgctaccaaactaatctccataaagaatcatgttgatgccctcagtggcttcccacagccttccaaatgaagtcccaacatctgagactggtatcaaagggtcagcccttcctttccagtcatctcccactcccctaccatcatagatcctgggctctgtaagtggatgaatcactcttctcccaatataccctaaaccctgttgattttgaactgcctatgctattcccttcaacatatctttctgcctacaaag

SEQ ID NO: 343800 - DNA, 547 bp, Homo sapiens
  misc_feature (3)..(3): n is a, c, g, or t
gtnaaagggcaaccaagctgggcggccccgcatagggttttttctttttttttgttcaaagtgaatacatgattatttttacttctgtacaatatatttaatatgaggtaaaactatcacatggctcaaaatctagtcttaaaaatataaaaaaggaattacaaaacgctctaaatgtgtagcattttaatcaagcctaagtccatggtgacaactgtgaaagtcacacatccctacatatatgcatgccggcttgcctgttaaaattccagttaaagtgaattttcacacactctttaaaaagattaaaaatgacattccttctatgtttgttcttctgagtttatcatgatctttcaaaggaattcagctacatactgtatttttgggggggccttaatttgacctttagaaaactgaggtggacctaactcaaaggagaggtaaagaagctgagaaaccacaatcataggaaaaaactaagattcccaggattactgtgggcatgaacaattacactatcatccctatcccaggaaaacttaaa

SEQ ID NO: 343801 - DNA, 377 bp, Homo sapiens
ctcctaaaccaagtaagtaaataagtaaataaataaaaaaggctttgaggagttcaaagtgaatacatgattatttttacttctgtacaatatatttaatatgaggtaaaactatcacatggctcaaaatctagtcttaaaaatataaaaaaggaattacaaaacgctctaaatgtgtagcattttaatcaagcctaagtccatggtgacaactgtgaaagtcacacatccctacatatatgcatgccggcttgcctgttaaaattccagttaaagtgaattttcacacactctttaaaaagattaaaaatgacattccttctatgtttgttcttctgagtttatcatgatctttcaaaggaattcagctacatact

SEQ ID NO: 343802 - DNA, 639 bp, Homo sapiens
ccatgttgcccaagctggtcttgaactcctaggctgaagcgatctgcccacctcagcctcccaaagtgctgggattataggcatcagccaccttgcccagccactgttctttctttctgtctctgccttctttccattcaagttagaaaataatcttcctgtcagtctgcctccattccagtgatgggcacataaatataactctcctggttggaaagctttcctctttctgagtaactgacatttcttgtcttcttggggctatcatgtgctaatacccacaataacatcaaaacctttcctgttatcccactgcccttacctattgcttttgtacttttgctttactttagccacaccatgttaccatatgtgcctcttccaggcatggaagctacatataacaccagcggcagtcagacgaggtaagcacatgagactcagcgtgtgtgtgcgcgtgtgcgtgtgtgtgtgcaagagagagagtgcatacataggtggtgtggatcgtctgtggcatgactttgacctcttgtccttgtaaacctgatctatgtctctcagataaacatttctgagattgaaatctgttctattacaagcagcaactaggaatgtgtaataatacaatttgttaaa

SEQ ID NO: 343803 - DNA, 2499 bp, Homo sapiens
aaataaaagaatattgggcagagtaaatttgtctttaaatgatagccattatggacagcaagataaaggaacatctctcagagaaacacaagaaatgactgaaggatcaagactagaaccaaactctgagtttggcaaagaaagtacctttggaatttcctcaaaagagtcgatgtcttgccatgatgaaagctctgtttccctaagaagcctgaaatccattgaaataatgccttctcaagaaaattcagaaactaatgttaacagtgaagaaactgacctgaaaaatctttgtaaaccaaaagatggtgaaatgctttgtgaaaatgtaaaggactgcacagtccttcctgagatgaaggaaatagtatcaagagattggagtaattctagtgacagagacagcgtatgtacctgtgtggaaaagaatgcttgcaaagcttgtcaccctcacgagaattcctctgacagacatttgcctttgacagtgaaaacagatattaaagtgaaaggagaagaaaccgaagagcatcagaggggacgactgggttacttaactgttggggagcaatctgaggagttggttaccagagaaactggcgatggcgatcccgtgagcaacatctctcagacccattttaaatgccgggggatacttaatcatgctgaaaaacagcagagccctgaggttttggactacatgttgcagaaagaagagaaatatatacgtcaacaaaaagcacatacgatatcgcaacagtgcatatcatctagtctgttgttagatgatgcacaaaatcagaaccaaccgaaggctgacaaagatgagtccaccatgatcaatgaaatcaccctagcaaagctggccaaggacagcattgtggcacagactcagaagttagaagaccagaaggaggaaaggttacatcatccattaaggaaggacactgagtcatgcacaagtccttgccttcttggtgcccctcggaaagcacaagacccctcctctgctgggtgtgatcaaatacatggtgcctttgcgaagaaaggagttcttcccttaaagaagcagccccatcgaacttgtaagaaagtttcctatcaggagcaaatcattgttgggagaaaaataggtaaaatcagaagttctgcctttttaaagagttcttccaatcccatccccacaaaagcgcacagacttctcagtttgtgtactctgtctgcacctacacgattagaacctgaaacagcacctaccaagagcttggttagtcacataccaaagcagatgtctacaccgtgccatcccttgaggagcctgaattttaggaagactaccaaagaatcagccttactaaacaagctgtccatccttgcctccaaactggccccagccatgaagactcagaagctaagataccgacggtgttcctctgaacttcttccaatggctaaaagctacaagcgcctcagatataaaagactcctggacggattttcatccagcacagagcagctgaatccatatttggcagctagcatggatgggataagaggcctaacagtaagcccatggcactttattctctcgaatccatcaagatgaccttcatagatttgagcaacaagatgccgtccctgctgtttggttctgaaatcttcccagtatcctttcatgtgaaatcatccagctcagattgcacgactgagtcctcaaggacttttcctgagcactgtgctccggcaaggcttgccttaggagaggccctccagtgcccgtctcaacctcccaagtggaccttttctttcttcttgtcccacggttgccctgggatggcaacattcagggaagacactggcgtccatagtcagacccacactcaggctcctccccagcctccagctcctctccaagactatggaggcactgccatagtccagaccagagcagactgctctgtccttggccttcacacacttctagcactttgttccccaggatgttaccgaatctggacaaaaaaacggagcttctccagccacatgcctaccatgcagaggctcttcatgacccagtttacacagggcctgaaagggttacggtctccagcctccatagcagacaaggtcttctgttctctgccctactcggtgggcagagtcctatccatttggagccagcatggtccttctgtctgctccttcgaaatctcttctcttcattcccctcactgcaagcggcaaccaagtctgggcaccacaagcagccacaccatgttaccatatgtgcctcttccaggcatggaagctacatataacaccagcggcagtcagacgaggctggagcctccattccctgccttggtaccaaagtcttgcttggtagcagaatcagctgtcagcaagctcctgctttcagcctctgagttccaggttcgtggattggatgagctggatggtgtgaaagcagcatgcccctgcccacagagcagcccccca

SEQ ID NO: 343804 - DNA, 834 bp, Homo sapiens
cagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatg

SEQ ID NO: 343805 - DNA, 820 bp, Homo sapiens
tttatctatgaacaaggtttatatatggaagagactgccaataaaaagaaggcctctgtaagaactgacctaggtgtaagttgaccctttcattgcttatgtttgtttttgacctgcccttcctttagagactcaagtgctttccctgggttttagaagggtcaaggttgctcctctttcctaactggaaaagacaatgatgttttatttccaagcacatatctgagttgtatgtgtggacagcactgagactgagtctttccacagctaggactgagtgtctccacatcctttctgaagcctacgaagctcatttatgtgctctgagatacatctattcaagcacataccaaggaaatgctcactgtgcatttggaagtaggtgttggacagttggactgcagatgttaggtgtctgtgtctctccacaacataggcatcaaccccaatctgccttacgttggccgtgagcattggtagagtcagcctgacttggcggaagcacgtgtaggtggtcttgcctgttagcttcttactcccccttgctgtgccctttgaggagtttgcctcacgttataattctacatattaggctcagcacctgtttttctttctggatgcatctacagcttaggttcctttaggtgtgaaaagtatgtccccatataggataggttgggttataaaggtgtcatttcctattctttgctgcatcttgaacagctgaccatggtgtggtgtcctttgatagtgttgtttgacagacaaagggctatctggcgatatgcttggcattttcctggggaatgtaactttatgg

SEQ ID NO: 343806 - DNA, 4615 bp, Homo sapiens
cggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactgaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgtcagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatgaaaaaaaaaaattaaaaaaaaaaaaaaaaaaaaaaaaaaaaaattttggggggcgccggggccccagaaaaaagcttttagaacacaccatccgggtgggggcggcggggccccaagggagaaagggacacacggggacaaaaaggggtacacaaggaaacccggggacaggagaaaaggggcgggggattctctcccccaaataataaaaacgcgccggggggagaacacgcggagggttttggagaacaaatcccaaagaggagggtccgggagggccaaacagggagactctatacaaagagggaggtccaaagagggagaccacgaaattacaaaatagaccccggaacgcgggcgg

SEQ ID NO: 343807 - DNA, 4720 bp, Homo sapiens
gtaatcttagtgcactacaacctcaaactcctgggctcaagtgatcctcctgcatcaccttcctgtgtagctgggactacagccctgcaccactgtgcacagcttccacacagtgtggaagaactgtgtgtggaagctgtgctggcttccatggctttgaagccgaatgttgtgcaagtgttgaagcagaatgttgaattagtcaattagttactttttttaaaattttctctttcctcctctctcttttctttcatctcctcccacttattatttaaagtagcagatttcttgctgaaaagcatttagataagcaaaaccaatttgttgtagaatacagttaaaggatgtcagctgatggtgctggctgtttttccagaggcctcacagaatggtattggcttgttgataagagagttatgagtccaggactcagccttataggctcagaaacccaactgttgacagtataataaccacaaatctattcctgatatgagggaccctcaaattaaccaaactagaaagacttgtgtatactcagaaggctaatttataaattttctaaaaactggtacctgttgaacagattagaatactctctttgatgagtgagaagggagcttggtaaacatgggcgtgagaatgagaataattgaagtgatttgagtgtccaagagccatcaaggataagattcataacttgatttgcagtgacctgtaagagtatggatttcaattacatttcactatccttgggcagtaacgcagcatatacatagctttgacagtgaccatcttctctgtgatgaatactttcattcttttcatatgtttaaaccctcaattttacattggtccacagaaaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgtcagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatgaaaaaaaaaaattaaaaaaaaaaaaaaaaaaaaaaaaaaaaaattttggggggcgccggggccccagaaaaaagcttttagaacacaccatccgggtgggggcggcggggccccaagggagaaagggacacacggggacaaaaaggggtacacaaggaaacccggggacaggagaaaaggggcgggggattctctcccccaaataataaaaacgcgccggggggagaacacgcggagggttttggagaacaaatcccaaagaggagggtccgggagggccaaacagggagactctatacaaagagggaggtccaaagagggagaccacgaaattacaaaatagaccccggaacgcgggcgg

SEQ ID NO: 343808 - DNA, 2554 bp, Homo sapiens
  misc_feature (743)..(743): n is a, c, g, or t
cggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaggacggctgctgctgaactgtccagcagccctctctctcagctcagcagctccctctctggccaccagaacagcatgacctctgcacatgcgacacgttccacaagcacgccacacactcatgccagcgtggagagcaccgcatcctccgccgccttctcagcagcggcgacctctgctccaagtgccccgtcctcaggggttgtcctgcctgggagcatgagcactgtgagcagcctgtgcctgggggggaccactgtgagcgtccctagcagcagcaccagggccacggcnttggtgacctcgcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatg

SEQ ID NO: 343809 - DNA, 4700 bp, Homo sapiens
cggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactgaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgtcagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggtgaggggtacttcccagacagagacacatggggttagacaggcttgcctggctcacacttgcctcttgtaccctgccacgctaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatgaaaaaaaaaaattaaaaaaaaaaaaaaaaaaaaaaaaaaaaaattttggggggcgccggggccccagaaaaaagcttttagaacacaccatccgggtgggggcggcggggccccaagggagaaagggacacacggggacaaaaaggggtacacaaggaaacccggggacaggagaaaaggggcgggggattctctcccccaaataataaaaacgcgccggggggagaacacgcggagggttttggagaacaaatcccaaagaggagggtccgggagggccaaacagggagactctatacaaagagggaggtccaaagagggagaccacgaaattacaaaatagaccccggaacgcgggcgg

SEQ ID NO: 343810 - DNA, 4560 bp, Homo sapiens
cggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactgaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgtcagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgttgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatgaaaaaaaaaaattaaaaaaaaaaaaaaaaaaaaaaaaaaaaaattttggggggcgccggggccccagaaaaaagcttttagaacacaccatccgggtgggggcggcggggccccaagggagaaagggacacacggggacaaaaaggggtacacaaggaaacccggggacaggagaaaaggggcgggggattctctcccccaaataataaaaacgcgccggggggagaacacgcggagggttttggagaacaaatcccaaagaggagggtccgggagggccaaacagggagactctatacaaagagggaggtccaaagagggagaccacgaaattacaaaatagaccccggaacgcgggcgg

SEQ ID NO: 343811 - DNA, 3580 bp, Homo sapiens
  misc_feature (3580)..(3580): n is a, c, g, or t
cggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactgaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgtcagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggtcgggtcagcgcagcagccgtcctgagccagtctcagctccaactgctcgcactctcctctggcaactaaccggaaagggggtcgggcccggttctgggggggaaccgctttgggccgcgtctatccggtggcggtcttgggggccccggcgtggttttttttgagggggggggggccccctgccctttccgctcgcggtgctcttgtcgtggttggttccctccggn

SEQ ID NO: 343812 - DNA, 3187 bp, Homo sapiens
cggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactgaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgtcagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtgagtatttcagagggtgtgactgtgtctcctggccttgggttgctggcaggtggaaacctgggacctatcttccagcagggagggagggttgtgattccactccgtcttacctggtcttcagaaactgttcaggctggggacaaggtcacttttcccctgctgtgtttagatccagcatgtgttgcactaatgaaaacacaggtcccctgtggttgtgggtatgtcacctgctgccttaggctctggcaggggtacctgaccagcctcagcttgcctcttcctacactaatacctcatctgcttgc

SEQ ID NO: 343813 - DNA, 2488 bp, Homo sapiens
cggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactgaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgtcagcctgtccagtagcatgaacaccgcgaacagcctctgtctgggtgggacccccgcgagtgcatccagcagcagtagcagggccgcgcccttggtgacctcaggtatttgctccagaggcctttcctgcccacccct

SEQ ID NO: 343814 - DNA, 989 bp, Homo sapiens
tccgttatattaggaggtgtattaaagaggtgtgggagtgctgaggtcacccatgttgcttggctgaggctggagggacaaactatgtggggccatactggaaggcactgggcatgcctgtttagtagggaagaccagtgtagctattgccaggtggcagggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatgaaaaaaaaaaattaaaaaaaaaaaaaaaaaaaaaaaaaaaaaattttggggggcgccggggccccagaaaaaagcttttagaacacaccatccgggtgggggcggcggggccccaagggagaaagggacacacggggacaaaaaggggtacacaaggaaacccggggacaggagaaaaggggcgggggattctctcccccaaataataaaaacgcgccggggggagaacacgcggagggttttggagaacaaatcccaaagaggagggtccgggagggccaaacagggagactctatacaaagagggaggtccaaagagggagaccacgaaattacaaaatagaccccggaacgcgggcgg

SEQ ID NO: 343815 - DNA, 1776 bp, Homo sapiens
cggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttccatgggcagcactgtagggtgtcagcaacacaagcaattttgcaacacagcaacacattccagacacacacgaacagcagcaccatcagcagcagcacgcaaaagctgcagcaaagcacatccgcagtctgtggcacgtgagaaaacaacaacctggcaacaggcacagcaggccggccaatccgtggtccagcagcaattctagcacggtgcacagacaaatggcacattgcattgcacatccaagctggacgaaaccattcagcattcgtgggcaaagcgcagccccgggcgtagcaggcatttgcgacgtggccagagggcagcaggggcacggacaccgttctcaaccgcaaggccatgggggtaccatttaagtcccagcagacctattcacgactacctagcactctacacgactgtgtgctgggaccaaacacgctaagaaagatattggagaacgctgacatcagaacatggcagcacgaatgaacgagcgacactgaaacatgggcacatcaacataacaaccacaacgataaactcacggatacttgtccagaacacacaagagcgtttcatataatagggaccatctcacaaacgcgggcgcccttagccgcaaggcaacattcccagtcgcgccaacgacgccagcgcaccacaaccagacacagcaactcggcaacatcgaccagaatccccatccctatgaaaaaatcgacaaacgagcgtagtatcccacactgccacctccacactacctcgacgtccgccacgcgcacacacaactcaccacattaaactgtaacacaatgtgaatagcacaaacaaggccactacggagagctcacagtacgattacgcaccactcggccctacgcccacgccacaacgacacatgagacaccacacatccagacacgacacccagagggacaacacaaagagcaccagcgcccaacaagatccaatacagagtaacacagcatgccacagaaaatacaacaaacgcacgaggcactcacagacgccacaagcacccaccacgcgcaccgtcacaacccacaacactagcacaaacaaacagcctataccacaaacattaagacaatagtgccccaacactgtggcactacagtcagtccatacgatcccaactgatgcggcttcctacactccaatgcaatgctatccatcctaatacaccacttatatccatctaggtatcctacttgcaaactctaccagacagataatagaagaccaacgagactttgcacccctaacacacaacacacatacgcgaccaaaaaaacatagacaaacaaactacacatcttcatgaatacacagcactaaaagtacgcggcatgaatcatgggacccagagatataaa

SEQ ID NO: 343816 - DNA, 493 bp, Homo sapiens
gaaatagaggtgctgaacaaaatgttttcttctttatctaatgtttctgtaaaggagcatataaatctaagctgtaaaagccaaacttggattctgacttgggaagaaaatacctgttgcctatttatgccttatttttcagcaggactctcataagagctcttattctgccttgaaagattatacgtctccttgtctgctttaggatgcagaggaccgtgtttcaggaaaataaggctattataccagaatgtgtggaaggtccctaggcaacttctggttttcacatctgcatctccatggctggcagaattagttatatttaaataggggaaggagaggtgatgtcttttacagtggctgtgagaaggcactgggcttgtttggtggaagatcatgtatggttaatattttggcttaggtgtttgcttcttttgcctttattatttctttatttcaaaccccaggacatttaatcctgcagactattcag

SEQ ID NO: 343817 - DNA, 435 bp, Homo sapiens
gcaccactggtctacctgatatgactggttctgtctacaataagacacaggtgagggacaaaggtgggttgggtgtataggtttttgagaggttacagcccaacctgaccttcaccattgtcttctttgccctgtagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacaggtgagtacagtgatggaggcagccaccctactctgggccaggggttctgctccagccttgacagccttcccttctcctcttcctcagagtggctcgggtcagcgca

SEQ ID NO: 343818 - DNA, 423 bp, Homo sapiens
gggcagatcacgaggtcaggagatcgagaccatcatggctaacacgatgaaaccccatctccactaaaaatacaaaaaattagttgggcgtggtggcaggcgcctgtagtcccagctactcaggagactgaggcaggagaatgttgtgaacctgggaggcggagcttgcagtgagctgagagggcgccatgcactccagcctgggcgacagagcgagactccgtctcaaaaaaaaaaaaaaaaagaaagatacatgcatgtgcctttgataattgtacacactttgaatgataaatgattaacagccgttctctctgatagacttcatgggagactgtagggtgtaagaaaaagaattttgcaaaagaaaattcagaaaacaaagagaatagagagaagaaaagcgagaaagaatcgagtcgt

SEQ ID NO: 343819 - DNA, 319 bp, Homo sapiens
gtttttaagtcacttttgtttttgtttttcctgtttttgaacccgttgtttaaattgtagcctgtttgtcattccttctttgcctttaataggtgcttgataaggttatgtacaagaggtttggaaatggaaatttgatttttctgctcttttccccctagttagaggtgaagaaaatggaattgattgcaatcaagtggacaaaccttcagatcgtggcaagcgagcccggggtagaggtaagctagagtaagagggaagaaaatgctttcaattagggggaagaagcaggcagttgcgttgctggactgtgactagg

SEQ ID NO: 343820 - DNA, 424 bp, Homo sapiens
ctgtttgcagaagccagtgtggcctttctctggttggaggaagggcagtggctggagtcagtgctctttcctaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtgagtatttcagagggtgtgactgtgtctcctggccttgggttgctggcaggtggaaacctgggacctatcttccagcagggagggagggttgtgattccactccgtcttacctggtcttcagaaactgttcaggctggggac

SEQ ID NO: 343821 - DNA, 4254 bp, Homo sapiens
cggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactgaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgtcagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatg

SEQ ID NO: 343822 - DNA, 4491 bp, Homo sapiens
cgcccgtgacgcgaggtcacgtgacgggttgggcagcctgtgccgccgccgccgctttgtaagaggcacattggcagattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagagaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgtcagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatgaaaaaaaaaaattaaaaaaaaaaaaaaaaaaaaaaaaaaaaaattttggggggcgccggggccccagaaaaaagcttttagaacacaccatccgggtgggggcggcggggccccaagggagaaagggacacacggggacaaaaaggggtacacaaggaaacccggggacaggagaaaaggggcgggggattctctcccccaaataataaaaacgcgccggggggagaacacgcggagggttttggagaacaaatcccaaagaggagggtccgggagggccaaacagggagactctatacaaagagggaggtccaaagagggagaccacgaaattacaaaatagaccccggaacgcgggcgg

SEQ ID NO: 343823 - DNA, 3814 bp, Homo sapiens
  misc_feature (12)..(12): n is a, c, g, or t
  misc_feature (17)..(17): n is a, c, g, or t
ggctcggtaccnattangctcctagacggaactggcatcaaatactcacaacatagctcaggatctgtcaaacaaaagttcttatggactcaaaggggcttggaagaattctgtggaagagtggacaacagaagactggactgaagatcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgtcagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatgaaaaaaaaaaattaaaaaaaaaaaaaaaaaaaaaaaaaaaaaattttggggggcgccggggccccagaaaaaagcttttagaacacaccatccgggtgggggcggcggggccccaagggagaaagggacacacggggacaaaaaggggtacacaaggaaacccggggacaggagaaaaggggcgggggattctctcccccaaataataaaaacgcgccggggggagaacacgcggagggttttggagaacaaatcccaaagaggagggtccgggagggccaaacagggagactctatacaaagagggaggtccaaagagggagaccacgaaattacaaaatagaccccggaacgcgggcgg

SEQ ID NO: 343824 - DNA, 4548 bp, Homo sapiens
cggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactgaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagcatgccagtgtggagagcgcctcttcccaccagtcctcagccaccttctccacggcagcgacctccgtctcaagttccgcatcctcaggcgtcagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatgaaaaaaaaaaattaaaaaaaaaaaaaaaaaaaaaaaaaaaaaattttggggggcgccggggccccagaaaaaagcttttagaacacaccatccgggtgggggcggcggggccccaagggagaaagggacacacggggacaaaaaggggtacacaaggaaacccggggacaggagaaaaggggcgggggattctctcccccaaataataaaaacgcgccggggggagaacacgcggagggttttggagaacaaatcccaaagaggagggtccgggagggccaaacagggagactctatacaaagagggaggtccaaagagggagaccacgaaattacaaaatagaccccggaacgcgggcgg

SEQ ID NO: 343825 - DNA, 3070 bp, Homo sapiens
tttatctatgaacaaggtttatatatggaagagactgccaataaaaagaaggcctctgtaagaactgacctaggtgtaagttgaccctttcattgcttatgtttgtttttgacctgcccttcctttagagactcaagtgctttccctgggttttagaagggtcaaggttgctcctctttcctaactggaaaagacaatgatgttttatttccaagcacatatctgagttgtatgtgtggacagcactgagactgagtctttccacagctaggactgagtgtctccacatcctttctgaagcctacgaagctcatttatgtgctctgagatacatctattcaagcacataccaaggaaatgctcactgtgcatttggaagtaggtgttggacagttggactgcagatgttaggtgtctgtgtctctccacaacataggcatcaaccccaatctgccttacgttggccgtgagcattggtagagtcagcctgacttggcggaagcacgtctccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgtcagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatgaaaaaaaaaaattaaaaaaaaaaaaaaaaaaaaaaaaaaaaaattttggggggcgccggggccccagaaaaaagcttttagaacacaccatccgggtgggggcggcggggccccaagggagaaagggacacacggggacaaaaaggggtacacaaggaaacccggggacaggagaaaaggggcgggggattctctcccccaaataataaaaacgcgccggggggagaacacgcggagggttttggagaacaaatcccaaagaggagggtccgggagggccaaacagggagactctatacaaagagggaggtccaaagagggagaccacgaaattacaaaatagaccccggaacgcgggcgg

SEQ ID NO: 343826 - DNA, 2390 bp, Homo sapiens
cagatccatgtgtcctggcttttcttttgccagcatgccagtgtggagagcgcctcttcccaccagtcctcagccaccttctccacggcagcgacctccgtctcaagttccgcatcctcaggcgtcagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatgaaaaaaaaaaattaaaaaaaaaaaaaaaaaaaaaaaaaaaaaattttggggggcgccggggccccagaaaaaagcttttagaacacaccatccgggtgggggcggcggggccccaagggagaaagggacacacggggacaaaaaggggtacacaaggaaacccggggacaggagaaaaggggcgggggattctctcccccaaataataaaaacgcgccggggggagaacacgcggagggttttggagaacaaatcccaaagaggagggtccgggagggccaaacagggagactctatacaaagagggaggtccaaagagggagaccacgaaattacaaaatagaccccggaacgcgggcgg

SEQ ID NO: 343827 - DNA, 3803 bp, Homo sapiens
cggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactgaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgtcagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtttcttgataagcatttattccctacctgaatacatgtgtactatatagtctgctttgtctagtgttgacacttagagctgtatcttttatg

SEQ ID NO: 343828 - DNA, 3472 bp, Homo sapiens
cggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactgaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgtcagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcaggtgggtacatgttctagtatcttccttcttaaaattgttttggataccacagccccacccatgcaggtggggctgtggtatccaaaacaattttaagaaggaagatactagaacatgtttgtatgagaatggacctatagctaggatggaattgacagtggcaatgagagggagtacttacaggattccatttggagaagccccaggaagtgcaactcatgggcacaagtggtaactgccggtcttgcttcagatccagggcaccctattaccgcggcggtttactgcc

SEQ ID NO: 343829 - DNA, 813 bp, Homo sapiens
cggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactgatttggactgccgagggagacggccggaaggttctcatccccgcataagtg

SEQ ID NO: 343830 - DNA, 345 bp, Homo sapiens
agaccccaccagacttgcgactctgtgtgtttacctgttcctggtagctgcccctccctcagatccctcctcaggacacttgtgagcgctgatttgctggcctggtaaaagccttcatttctcttctccttccaggatgtgttgccaatggccaacaaagacatggagaaacctggacaactgtctaatgtctctgggttcttggaacgaggaagcctgtatatacaggggatgggggcaggtgacagcgtgtggttctgagagcacaagtacaggtggcccatcgcagccctggggagacatgggttggatggggagaaccagagccctgccacagaccccagg

SEQ ID NO: 343831 - DNA, 322 bp, Homo sapiens
tctatttgttgaagaccctgggttgtctgtcctacagaaggccccattctggatgtttgttgattatattcccttggggccgtgagacacattcctggttccctgtatttccaagaggtgtgttaatgttggatcatctctcttttgtgatgttgttagcaattactgcttgttggccaggtccattaattcatgggggactgcaaaattgtgacagtgaccaatgacggttcggcagtttgttgtatttttttagtgtgttgagttcctccccccgtcattatgaacccaaagatttttaatatatctgatatgttccaaa

SEQ ID NO: 343832 - DNA, 319 bp, Homo sapiens
atatggaaaaatagataactagcttcttagggaagtgtgtgtaaagttagtatggaattagggaaggatgttagtaatagagtgattaataccctgttttgcttctggcaggatgtttagatctgtatttcttgcatttctcgctgtattttgtatggttatggctattatgtgaaggagatattttgtatttgtctttacaaggtatcatgtttaccagtacttacccatgagctcatattagatttggggcttctgaagatagattctgtttttctcacctttttcctcctaatgcctggcccattggttagtagaa

SEQ ID NO: 343833 - DNA, 385 bp, Homo sapiens
tcagaaattaagctccaacttgcactggattcattgtataaaggaaaataaatcagaattgattctcaagtgtctttttaaatgtcaccattcattcatttgaaatgtatttccttggacttttcagcagaaggctgtatagcagttataatcgtttattcatccaagctatatagaggcctactatgtggcaggtaaagtgcttggaatatattattcaacaggtagtaaaggtctctgccctcttggactttatagtattcaagctgtgaaagagaatgagcagtacatgaaaaacaagtaaagtagaacatattttaagggtgttaagtatactttggaaagaaagggaaaaaacagagaatgggaataccaacggtaggac

SEQ ID NO: 343834 - DNA, 394 bp, Homo sapiens
atcaagtttaatttgactatatccagctaaacaattgattgaacttcacttgcttttctatgacaggttttttgttcttagtaaaagaccccagttttctcacttgtgaacagaaggggttagacttcatgacagctaaggttccttccgtctctaacaaaagtggcctgaagagaggcttctagactatactcacggtgggttcttgggacctcagagtcagctccatcacttaagtggctgtgtgattgagtggagacacctcaatctctttgtgcctcagtttcctcacctgtcgagtgtcaacatgatggcacctaaagctgttgagacttcagaaaggtaatgtgtgaaaagtgaaaagtgcctggcatccaggaagtactcaataaat

SEQ ID NO: 343835 - DNA, 556 bp, Homo sapiens
tcttgcagtttctgggatggcagaggcagaaggaaatctgtgcatagtggacctgcacagttgaaacccatgttgttcaagcatcaactgtactttaatcttctctagattacttataatccctaatacaatataaacactatgtaaatagttgttatactgtattatttagggaataatgacaaaaaaactacatgttcagtacgacacaatcatccattttttcccaaatattttcagtctatggttggttgaatccacagatgtggaacccatggatatggtgggctggttgtacagtaattttaaagacatggaatcttctgaagagaggaattcttctaattgtactttcctagccagtctcagaaagtagtgttaagactttcaatttaagaacacagtttaactggaaagcttaactggagacaacaaacagagctacttcttttaaaattctgttttgtctctggcagaaattcacatttgttccttactgtcattcttgtctttattactcatgttcccgcctgaaaatttccaaataaattgtgtc

SEQ ID NO: 343836 - DNA, 563 bp, Homo sapiens
cgcgcctgcagcgcgagaaaaggcagcaggcagcttggtacctccagggctgcggagtctctaaggaggctgcaagagcccagagtcgccgctgattggctcctcccgcggccttgggaccacccttctcaccaccgttgcctcccgcctacaccacccacctccttaatcaaagccaatgattgcatccttcccgctctattgtggctagtggaaagcaggggcccctgcgggattgcccaggcagtgcaacagtccctgtctggaactagttaaatccttcctccagattcagacgccagcattcctttcagaaaaacaaaagtgtatgttccctcccctccttcagatccgtaccccagcttttctttcatgaacaatgagttctcttatactcctccttcccatattaaactcttcccctttcccaccttccacacgcatatccctcaatctcaatagctccagggatccctacctttctgcactgctgttctaatgcaaataaatatattttttaaaaaaatttaaaaataaaaacaaagatataaatatgaagctcc

SEQ ID NO: 343837 - DNA, 341 bp, Homo sapiens
gcatctgccgttgtctgctgaactgggtcccaatgtctcatttcttcactgtgctcccctcctcaaactgggtcatgtggagaaatcagggccttgggggctcagccagaaataaagaccgagagatcctccagagagaaggtcctctaggagaggaagggtggcagaacagaagaggcccgggacttgcttcccaaatgtcagaaattaccaaaaagcttcacagttcagagagaacagtgtatttattttaggagccagagtagtctgacaggaagacttgctttcaaacatgtcctgttcacgtatgtacttagcagatggctatttgacacttcctg

SEQ ID NO: 343838 - DNA, 828 bp, Homo sapiens
ggcacccacagagggaccgtggggttggctgctgcccaccaccctagaggaaggcctcacggggagtggctactcttctggctgcccggggtggcctcactctcactccaggcatctgcctgccccatgggagctttcccttttctggggcagagaaggatgctgcccaggtgtgggcagtcaagcagggtgcagaggaacccagatcagagtctggggctgggtcccaagccctgttctctgtttcactcacaatatgagctggggcagtctttttcccctcctgtgtgtcagtttcctcatttgtacaagaggcatttggactggaacagggctgcttacactttgaatgaatcccctaggggtcttgttgaagagcaggctcagattcagtgggtctgggctggggcctaagattctcaatttctatcaggctccccagggagggcgattctgctggtccatggaccacactgagtagaaagggactgctaagctttgccattgtgtgactttggagtctaggagcagggagaggcctgatgccccttcttcaccatctcaagaaggcttcctgctatgaggaagattttagacacagatcagggagcaggggcttttatccctcttgaaaaaccagatgggaaaactcgaacttgcctgaaaaaggctgtgcctttctcagcagctgctgcccctgacgtgcattattttacagcagacatttcctccaaattcttgtgtctcatttcctctacaaggacacaataagtcccctttggtatctccctccagtgggggtccctctgcggccatcagaggaggcct

SEQ ID NO: 343839 - DNA, 381 bp, Homo sapiens
cactccagagataaaggagctattaagagctgagtgtgagtggaagtaatccactgcctgactgaaataacaggaaatgcctatacagctggctctccttatctgtggattcaactgtgtactgaaaattaaaatggccaaacatttttctatgtcattaccccctaaaaaataagtataactattatttacatgcacttacactatattcggtattataagtaatctagaaataaaaaataatgggaggatatacataggctatgcaaatatgccattttgttatcagagacttgagcatcctttgatttaggtatctaggtatgtcctggaagcaatccctgacagatactgatggaagactgaatttttttttttttt

SEQ ID NO: 343840 - DNA, 487 bp, Homo sapiens
atgttgagagaatttcacaaagtagtgctgtaggagaactaatctggaaactgtgaaaaaggatttgggggaaagggagaagaacagaaggaagggaggttaattcttgtaattatctaagcatgtgttggagacaggagcctggtaccagcatcagaaacaatgggacagatgtgggggatgatgagaatacagtcagctggtgggaggaggccatcttccaacaccaatgtctcaaaaagcgttttgttccattggctggtttggttggaaagtgcattatttatagatctaacatgaatttatctcacagtcaacagcaattcagaattgtgcattaatattttttaaagcaaagaaaacagtcaaagaaagcagaataattcagtggagagagcacctggtctcacagtcagaagcccacaaatctatttctggctttttgagcaatgttgctcatcaccttgcacaactgaatcagtctcag

SEQ ID NO: 343841 - DNA, 381 bp, Homo sapiens
tggaatatgagcagaagtgatatatgctacttgcaggccagccttaagacagtgggcaaatgtcctctatttcctcttccctcttcccactggactacacagtgacccatcattaaccaggcaggtgacaacaatgccccaggagatgccagaggagtgacttagaacatggtccctgaatgacccatcaggattagagttgacttgttgaactggacccattcacctcagaattatcatgtaggggaagacatacatctatatttagcctcttgttttgttcctctgtgcatatccaaaatgtattgtctttctaaatattagctctaattttggtatacctctagggagcttatgtttgctatgaatttgtaaagcaga

SEQ ID NO: 343842 - DNA, 494 bp, Homo sapiens
gtgtttttcttggtttaatttttaattaattaaaaaatagatggtaccatgtacattgtaccaattcaaaatgtataaaagagtatttggtgaaaagtaaacttccctcctgctttgtcctccaattttctgatgttcccacccagaaataacctctttttcaggttattttgtatccttctttccaggaattttctatgtaaacatataggtatgtattatatattaaattttgtttccccacccccccgacaaatggtagcatcctaaacatattgttctgtattttacttttttcccttcactaaacaaagaaaaatacattttactttttaaagttaatatatttggatgttttctagtcagtacatattgattggaaaatcaacaagaatgagaaaatatctacattatttttaaaggctacattgtattctgcgatacatacggtccataatttaacagtcctttataagttgttttttgcttcttgg

SEQ ID NO: 343843 - DNA, 365 bp, Homo sapiens
gtgtttttcttggtttaatttttaattaattaaaaaatagatggtaccatgtacattgtaccaattcaaaatgtataaaagagtatttggtgaaaagtaaacttccctcctgctttgtcctccaattttctgatgttcccacccagaaataacctctttttcaggttattttgtatccttctttccaggaattttctatgtaaacatataggtatgtattatatattaaattttgtttccccacccccccgacaaatggtagcatcctaaacatattgttctgtattttaactccgggccaggccctggtcaatgacggacacgtgcaacgccttgcatgcttgacagtatctgagctcttacgt

SEQ ID NO: 343844 - DNA, 307 bp, Homo sapiens
ctaaccttgcccaaagaaggaacagagaatcacctgggaggtgcccacaccctccacacagcatttccctggggtatggggaagcctaggattacaccatggctccagaaacgtgactttcatccagccaagccctgagctgtacaaactcttggacaaggggttaatttcaccttcagcaaaatataagctcctgggggtttctaaaagtgccaacacttccagatctttgcatatctctagaatgagttcctctccctcctccctgctcaccttccctgagccaaccccaatccttctccagcct

SEQ ID NO: 343845 - DNA, 3183 bp, Homo sapiens
gagtgttggggttggcggccacagctaagtccaacaccagcatgtcgctgcagagaatcgtgcgtgtgtccctggagcatcccaccagcgcggtgtgtgtggctggcgtggagaccctcgtggacatttatgggtcagtgcctgagggcacagaaatgtttgaggtctatgggacgcctggcgtggacatctacatctctcccaacatggagaggggccgggagcgtgcagacaccaggcggtggcgctttgacgcgactttggagatcatcgtggtcatgaactcccccagcaatgacctcaacgacagccatgttcagatttcctaccactccagccatgagcctctgcccctagcctatgcggtgctctacctcacctgtgttgacatctctctggattgcgacctgaactgtgagggaaggcaggacaggaactttgtagacaagcggcagtgggtctgggggcccagtgggtatggcggcatcttgctggtgaactgtgaccgtgatgatccgagctgtgatgtccaggacaattgtgaccagcacgtgcactgcctgcaagacctggaagacatgtctgtcatggtcctgcggacgcagggccctgcagccctctttgatgaccacaaacttgtcctccatacctccagctatgatgccaaacgggcacaggtcttccacatctgcggtcctgaggatgtgtgtgaggcctataggcatgtgctgggccaagataaggtgtcctatgaggtaccccgcttgcatggggatgaggagcgcttcttcgtggaaggcctgtccttccctgatgccggcttcacaggactcatctccttccatgtcactctgctggacgactccaacgaggatttctcggcatcccctatcttcactgacactgtggtgttccgagtggcaccctggatcatgacgcccagcactctgccacccctagaggtgtatgtgtgccgtgtgaggaacaacacgtgttttgtggatgcggtggcagagctggccaggaaggccggctgcaagctgaccatctgcccacaggccgagaaccgcaacgaccgctggatccaggatgagatggagctgggctacgttcaggcgccgcacaagaccctcccggtggtctttgactccccaaggaatggggaactgcaggatttcccttacaaaagaatcctgggtccagattttggttacgtgactcgggaaccacgcgacaggtctgtgagtggcctggactcctttgggaacctggaggtcagccctccagtggtggccaatgggaaagagtaccccctggggaggatcctcattgggggcaacctgcctgggtcaagtggccgcagggtcacccaggtggtgcgggacttcctccatgcccagaaggtgcagccccccgtggagctctttgtggactggttggccgtgggccatgtggatgagtttctgagctttgtccctgcccccgatgggaagggcttccggatgctcctggccagccctggggcctgcttcaagctcttccaggaaaagcagaagtgtggccacgggagggccctcctgttccagggggttgttgatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagccgctgggcctccactgcaccttcattgatgacttcactccataccacatgctgcatggggaggtgcactgtggcaccaatgtgtgcagaaagcccttctctttcaagtggtggaacatggtgccctgagacagctcccacccaccatcctgtccccctggggcgggcattggccaggtggtggagacagagacaggccctgaacgataagcaccaagagacccaaggctccagatggaacactgagggtgaccgtccctctcagaagcttttccctggagtgtcatgcctcacctgcaacccatgtggttctcagacttgaatcttctcggcccccaaaaatgaaggacctcatttcttatagcctctcctgtgattcaacacaacccatggagatgtccccttctcactctgaaatcatccatttggggacaaatccacattggggtctagaaacatccacgtatctcatcagccatcttgtcctgtgcatcctaacagaggaaggatccatgattctgctttggtccaattgcttcctctctgcagaggaacaaccccaaaaccagaccactccacgcaggacaggcaggagagattcttcctaaagcctcccccataaaaagggagctgtggatccacttagatcagggcggaaccatctttcacccggccaagctcctgcccagatgttgaccctcacccagcgtgagctttcacatagtaggagcttctagatgcatgtggaagcaatgagagttgtcccttagccttataaactccccatgatctgacatgcagaaatccagccttgtccagaatcctcctggaattgcttggaggacgaaagtatgctgggggatgggtgggtactagggagactgggtacaagggtgaaaagtagttcccataatacacatggttgactatggtgatccaccttgtgatggttaatattaggtgtctggagaaggttgcttcattggccctgggacttctctctgcaggaggagagaacgctgcctctcctctggattggtctcaggctctctgttggcctttggtcagcgtttccacatcctgctctgctgcaggagagggggctaaggggctggatccaccaaggcagctcacagcgggaaaactctgggactgaaccactgaattcaggggatgggggtgggggcccggttctcgaggtgtgtgccagctacacgtgtgttctgtatgggtccagctgcgtttccatcactcgctaataaatcaacagaaacac

SEQ ID NO: 343846 - DNA, 535 bp, Homo sapiens
agtagagacagggtttcactatgttagccaggctggtcttgaactcctaacttcaggtgatccaccgccttcggtctcccaaagtgctgtgattacagacatgagccaccgtgcccagcctgtagatgtatttttgtaggaaagatacctagcagtggaattgctgggcttggggtaaacattactttgttggatgctgccaaattgtgctccaaaaaggtatgagcgccagtcttagaaaggaagaccctttcccccagccgtggcccccactgtgtattacctgtcctctcctttgccagtggaggtgaaaggagggagttgttggaggacttggaatttttggtgaggctgcagacctcttcctgtgtccctcatactcatgctccctgggcccacagggagtcacagccaccccgtccctccccttccaggtcctgaggatgtgtgtgaggcctataggcatgtgctgggccaagataaggtgtcctatgaggtaccccgcttgcatggggatgaggagcgcttcttcgtg

SEQ ID NO: 343847 - DNA, 375 bp, Homo sapiens
acgttgacacttcaggtaaattgtgatgctccctcaagttttggttcttgttttttgttgtttgttttttagtttttaagagacatggtctttctctgttgcccatgctgcagtgcagtggtgtgaccaagactcactgtagcctcgaactcctgggctgaaagccatcctcccaccttggcctcccaagtagctgggaccacagggttgcaccatcttgcctggcaataatttttcatagagacagggtcttactatgttgcctatctctacaaaaaatagagacgggcaacaagctggttttgaactcctggcctcaagggattcccccaccttggcctcctaaagtgttgggattacaggcatgagccacca

SEQ ID NO: 343848 - DNA, 412 bp, Homo sapiens
  misc_feature (21)..(21): n is a, c, g, or t
aagaaaaaagaaaaaaaaagnaaaagagaaaaggagaaaaaaaaaaaaaatttttggctttcttagttgagctgtcttcctgaggttgtttggagccgctgcgtcatggataaataactccctaaagccagtcccaacaagcttgcactgaacatcaagaagcctgacaagtccttcaaatgcaagaagcccacccaaaatgtgctggtctttttaatcaacagacaactgggcaggcacagaagcgacatcaacctgtcaaggtggatatggatgctgtcataaagcaactccagggtgaacatggccttggacaaagagtcatgtggcttatgtgctgaggcctgcccagaattctgagatattaattataattagaacaataaactcctcccatgtttgagctattaaa

SEQ ID NO: 343849 - DNA, 653 bp, Homo sapiens
cctaggtgtgtctacagggtgctgccaaaggagattagcatttgaataagtgggctggggaaggcagacccacccttaatctggtgggcgcaatctaatcggctgccagcaaatataaagcaggcagagaaatgtgaactattgagacgggcctggcctcctagtctacatctttctcccctgctggatgcttcctgccctcgaacatcagactccaggttcttcaattttgggactcagactgactctccttgctcctcagcttgcagacagcctattgtgggaccttgtgatcgtgctttcttagttgagctgtcttcctgaggttgtttggagccgctgcgtcatggataaataactccctaaagccagtcccaacaagcttgcactgaacatcaagaagcctgacaagtccttcaaatgcaagaagcccacccaaaatgtgctggtctttttaatcaacagacaactgggcaggcacagaagcgacatcaacctgtcaaggtggatatggatgctgtcataaagcaactccagggtgaacatggccttggacaaagagtcatgtggcttatgtgctgaggcctgcccagaattctgagatattaattataattagaacaataaactcctcccatgtttgagctattaaa

SEQ ID NO: 343850 - DNA, 382 bp, Homo sapiens
aaaaagcaatctgagtggcctgacaggctttcttagttgagctgtcttcctgaggttgtttggagccgctgcgtcatggataaataactccctaaagccagtcccaacaagcttgcactgaacatcaagaagcctgacaagtccttcaaatgcaagaagcccacccaaaatgtgctggtctttttaatcaacagacaactgggcaggcacagaagcgacatcaacctgtcaaggtggatatggatgctgtcataaagcaactccagggtgaacatggccttggacaaagagtcatgtggcttatgtgctgaggcctgcccagaattctgagatattaattataattagaacaataaactcctcccatgtttgagctattaaa

SEQ ID NO: 343851 - DNA, 408 bp, Homo sapiens
tatatgtaattattcaaaacgggaggaaaaaaaaagaaccttgctgtgtacagctttcttagttgagctgtcttcctgaggttgtttggagccgctgcgtcatggataaataactccctaaagccagtcccaacaagcttgcactgaacatcaagaagcctgacaagtccttcaaatgcaagaagcccacccaaaatgtgctggtctttttaatcaacagacaactgggcaggcacagaagcgacatcaacctgtcaaggtggatatggatgctgtcataaagcaactccagggtgaacatggccttggacaaagagtcatgtggcttatgtgctgaggcctgcccagaattctgagatattaattataattagaacaataaactcctcccatgtttgagctattaaa

SEQ ID NO: 343852 - DNA, 401 bp, Homo sapiens
atagatcttcagtaataaataatcacaaaacaaaatagccaacctgctttgttaccagagctgacttttctgagttgtttggagccgctgcgtcatggataaataactccctaaagccagtcccaacaagcttgcactgaacatcaagaagcctgacaagtccttcaaatgcaagaagcccacccaaaatgtgctggtctttttaatcaacagacaactgggcaggcacagaagcgacatcaacctgtcaaggtggatatggatgctgtcataaagcaactccagggtgaacatggccttggacaaagagtcatgtggcttatgtgctgaggcctgcccagaattctgagatattaattataattagaacaataaactcctcccatgtttgagctattaaa

SEQ ID NO: 343853 - DNA, 240 bp, Homo sapiens
tcaggacatgagtgtaattgttaatgtcatcacaagacctttctacaagtgtcatgtgacatacatcttagcccagcatctgagttatttgtcttttcctgggaccagtccacagtgccatatcaccgggcccatacccttggtaatgtgattctattctgctttgataaagcgcacagtggtcattgtgacattgcttggtgttgcacccaggtggtgtgagtcggctcttctgccttg

SEQ ID NO: 343854 - DNA, 358 bp, Homo sapiens
ctgtgagatcaccgcctggcagggacgccagcacgggctcccagccacagggcagctcccaccctgcgaactccagctcttcccaggccgctccagaggccaggctgcacaaacaccttggctagtctccccacctggcacaggccctgttcactccaaccactgccttctctgagcacacaccaagttggagcccacagccaagcagcgggcggccacgggggattcctgcctcctgagtcctcaactctcttggcccggagctcacaccggcatttcagattttctccttccccctgttacccccgccttgccaaccacctccctgtggacctaaagccaccaccttccgggcaca

SEQ ID NO: 343855 - DNA, 272 bp, Homo sapiens
tccagcctgggagttacagcaagactctgtcttaaaaaaaaaagacaagatttgagagttctgagcattacaggcagtacttgaaatcacatgcagatgagacagctaaggagagtgaagatagaaaaggaccaaagatacaaaataaagggaagagaaaagagataacaaagatgactaaggagtggtcagaatataaggaggaaaaccagaagagaaaggtatcacacaaatgaaagaaaaatcaagttaatctcaatttcaaggacagg

SEQ ID NO: 343856 - DNA, 122 bp, Homo sapiens
cttttcacagccacttcacttctgccacagggattggtttagggctgagcacatgacataaattaagtcatcaggaggcagactcaagacatctgttccagcattgtaaagagagacgctct

SEQ ID NO: 343857 - DNA, 262 bp, Homo sapiens
ctttatagtaaaccagtaaacaaaagtgcagtcttgtgccacataatgtgtttttgtcaaagagggactatgtatatgactggtcccctgagattataatactatatttttactgtaccttttctatgtttagatgtgttttgatacgcaaataccattgtgttacagttgcctacagtattcagtacagtaacgtgctatacaggtttgtgctctaggggcagtaggttatgccctgttgtctaagtataccatatagcct

SEQ ID NO: 343858 - DNA, 485 bp, Homo sapiens
actcagagacccagtgccattgttggaatcaacttgctcttgttctcggatttccactttctgtgccacctgggtaccctcatggacaattggcatcattctttcccagtccagttccattatgggaacaagtacttagggaaaacagggcaacccagtagtagaagccctggtttgggaatcagacaatctgaatacaggaccttacattgccgtgaactctgtcactgagcaggcagaacctgattgagtggtatggctttggtaggcgctttgcagaagtttattagtggattgactaggacaaattctctcttatagttccttcagttgaaaatagagatgacttttgtacttcattaccataaagctatgctaaaaataatacattaatgaaagttgtttcttggaaaataagaaatggaaatataatgtattaaatggagctggtttgtaaaatatggtgtggttgagacagtatctca

SEQ ID NO: 343859 - DNA, 622 bp, Homo sapiens
ttaaaattcctttctaccattcacaagcgttttcaaataggaaattaatgaagactaaataaatgtatcccctctgcaaagagttacgagaaaatttctgtaagcgtcacagtggcaaatgttagttttaattaatgaataaattaagttctgtttaggaaaaaaaaaaagaaaaagagataaaagaaagcacactatttgacccctcccgctaaattcattccaactccaattagggcatcctggtattgaccaagatgaagaaagaaatgaccactgctgggaagctgcctctctgaaaagttcagggatttagggtacactgaacatggccaaaaggcaaattcacaagcacgtgagaacatgtgatgaaaatctatcagcacagtaccttagatctctgagactaactcagtgaagacgctaaacatcagacggcactgtaagcaagcaaaaggcaataccaagattatcccaaagatatctctagcaacccacaagttacaagaacacaagttccttaaaaaggggcgtggaaacagctgtgttataaactttctggaaaccaacttggctatacatatcaatagtgttaaaatctggcatattttatctccaacat

SEQ ID NO: 343860 - DNA, 588 bp, Homo sapiens
atcctaaaaaccctattcttttgtaagacaagaataagtttcttagctacctctttgagagaggaatttccttgaagttataattagaaatgatactgttacagtatcatggaccccaatcccttttgatatgggctgtcctggacaaatgccagcacatgtggttatccaatttgtcccataatttcttgtagcaagtaacaacaataaactttttttaaaaaaaattagaagaaattgctaattactaaactctatcctgtctatatcagaaacatactaagaaattcatatgacacttttattttggtattcttaaaatacttaaaaacgtacacaaattcatgttttaatcttcattccttcttctttcactccattgagtttgatgctggcaatattaggaaagggagaatctgctaataatctaggctaataatctggtaatgattttcaatcaattatcaaattctgttcacagtaaatatttgtaagaggataggaatttagacagcagatgtttcttcatattaaaagtaaaatctgggccaggtgtggtggctcacgcctgtaatcccagcactttgg

SEQ ID NO: 343861 - DNA, 514 bp, Homo sapiens
ttctttaatcctcataatagccctctcctgcagagctgcttttatgcccatcttagagattaggaaatcgaggcaccaagaaggctaagtaatgtgtccagtttgtagctactaaatggcccacttgagatttaaaccaaggcaagcctggttccagagtgtgtactcagggtggatgcttactaaataataacatggtagcagtgactgtgtttagtagggggactgtgagctatgtgtttactttgctgttaatttctatttttctatgagaggccgaggtggacaggtcacttgaggtcaggagttcgagaccagcctggccaacatggcaaaaacccatctctactaaaaatacaaaaattagtcttgtgtgatggcaggcacctgtaatcccagctactcaggaggctgaggcaggagaatcgcttgaacccaggaggtgggggtgcagtgagctgagatcacgccactgcactccagcctggacaacagagtgagactctgtctcaaa

SEQ ID NO: 343862 - DNA, 362 bp, Homo sapiens
gagctatttcccctgtcaggattgtgtttttaaagtagtactgttttgagtaatttacttgatgccaaccctgtcccttgacagtgttattcacttcaacacagctgcaactctctaaaagagacatcagtattgcccaagttcctatgataaactgggctctgaaatgttcagtaactcgcccaagttctcacacttcgttaagtagcagaaccaggattaaccactagctataacaccaaagtccatgtacttttcattaagccatgatgcctctgaaaattagccagatctgagtttttgctttcatggaagaatagagaatcagcctggcgtggtggcttacgcctataatcccagca

SEQ ID NO: 343863 - DNA, 603 bp, Homo sapiens
ggttatttttttggttcacataaaaatattttcccaacgaattctactgttggaactattcaggccttacccaaaatatttctctcttcattttctaccaatctcaaacagtaaagaataaaagcgttctacggcctggaagttggcaccaacataagaacatttttaatacttactgtcctttcccacttttggtggggaagtggtaacccttaaacatccatccagaactatttcttttattaatgtagtttgctactctctgaaccctcagctgtaccactgctgtacttaattatcaccttcagcaaacacaaactatcactgatttttaatataaatttctaagcagtaaacaacagatccttataaaattcaaatcccgacaactaagcaaatggtataatatcaccctatactgtaaccaaactttatctccaatgggtaaacccattttacttacatatggattttgaattaaacccagaaagcatatcatctcttgagctctgaaagcagtgtttaaccattacttttccaactcatagtctcttctgataaacataaatatctcctgcttacatttaatattgttacccaaat

SEQ ID NO: 343864 - DNA, 232 bp, Homo sapiens
gacatcactcaatacttttacccagagccaaataaataggtaagtcaggcaatgtattagtccattcttgcatcactataaagaaatacccaagactgtataatttataaagaaaagagttttaattggctcacagttctgcaggctgttcaggaagcataggacttctggggaggccttcggaaactttcagttatgacggaaggtgaaggggaagcaggcatatcttaca

SEQ ID NO: 343865 - DNA, 311 bp, Homo sapiens
gtctttgccaggttttggtatcagaatgttgctagccttatagaatgagctagggtagaatctcttcttaattttttggaataattttatattttattaatatatgtctggtagaacttgactgtgaatcggtctggtccaaggcttttcctgattggtagatttttttttattactgattttatgtcagaactcattattgatctgttcagggtttcagtttcttcttggttcagtcttgggaggttgtgtgtttctgagaatttatccatttcttcttccaggctttccagtttgtatacgtagtggtg

SEQ ID NO: 343866 - DNA, 1453 bp, Homo sapiens
tgacatgggcagagtttctcttgcccttaaagtcttactttccacttctaaataccttccaagatgttttcctccacaaacacaatatcttccttaaaagatagaccctgcatcagttgttaagctaacacatctttctcctcactacaaatgtatcactattgaatttctctccacaagtgtgaagatggctggagtagaaattctggcattgcttctcatcaccagaaggaaaaattcagagaaacagcccgaccacccaccctgacaaatgcctgaggcccacatgcagcctgcaaaactgcaaacatcactgcccaccacagaccacggaagcaagaagcctgtttcctgttacttgccaccactcagcaatgcccaccccatgtgtatagaggtccagaatgctcaaaattgttcttctgctgctgcaacattggagccttccatcatctcagacacatgcttttataaaccaataacaaaggatcaactttcttctaggtctgaattgaatactgtgaggctaaagtgtcttaactcattgagggggtggaaaatattaaaccaactaagccttacctaattacaatgccctgctgctgctcatctccctttattcgtttgtactcatactcaaaagaggttgtgtttttttcccttcattcaataacgattttccttgattcttagataagtccattccataatgtactccttaactgttctgaatttctttcagagaaaaactggaaaagacattaaatcatgttgaaatatttgactgactttcatctaggaaaaaatataaagttaaatctctacactaaaatataaacaaaataaaaagaaatttcagtaagaccaaaacatttacttttaaaaacctatatcatgttatatgtataactgaggaatgtaatcataattttgatttgtagaactgaagacaatatcaagtaaccctcaaaatgtaaattcaagaaacaaggtagttacgttagcctgcattaaaataaaaatatctgtgtgacaatatatgctgtagagcaaattaaaaaacaagtgaaaaggttgggtaaatatttgcaatacatattgatacggtttggatttgtgtccctgcccaaatcttatggcaaattggaggaggggcctggtgggaggtgattggatcataggagcggatttcccccttgctgttctcatgatagtgagtgagttctcacaatatctgatggattaaaagtgtgtgcacctcccctcttgcactttctctccagtcaccatgtgaagttccttgcttccccttctgccatgattgtaagtttcctgaggcctcccagtcatgcttcttattaagcctgtggaattgtgagtcaattaagcctttttattcataaattatccagtctcaggtagatctttatagagtgtgaaaacagactaatgc

SEQ ID NO: 343867 - DNA, 1276 bp, Homo sapiens
cgattatccttcatcatccaaccataacacgcatcaatcgaagagaatatacctaaacagagaacagaaacagcccgaccacccaccctgacaaatgcctgaggcccacatgcagcctgcaaaactgcaaacatcactgcccaccacagaccacggaagcaagaagcctgtttcctgttacttgccaccactcagcaatgcccaccccatgtgtatagaggtccagaatgctcaaaattgttcttctgctgctgcaacattggagccttccatcatctcagacacatgcttttataaaccaataacaaaggatcaactttcttctaggtctgaattgaatactgtgaggctaaagtgtcttaactcattgagggggtggaaaatattaaaccaactaagccttacctaattacaatgccctgctgctgctcatctccctttattcgtttgtactcatactcaaaagaggttgtgtttttttcccttcattcaataacgattttccttgattcttagataagtccattccataatgtactccttaactgttctgaatttctttcagagaaaaactggaaaagacattaaatcatgttgaaatatttgactgactttcatctaggaaaaaatataaagttaaatctctacactaaaatataaacaaaataaaaagaaatttcagtaagaccaaaacatttacttttaaaaacctatatcatgttatatgtataactgaggaatgtaatcataattttgatttgtagaactgaagacaatatcaagtaaccctcaaaatgtaaattcaagaaacaaggtagttacgttagcctgcattaaaataaaaatatctgtgtgacaatatatgctgtagagcaaattaaaaaacaagtgaaaaggttgggtaaatatttgcaatacatattgatacggtttggatttgtgtccctgcccaaatcttatggcaaattggaggaggggcctggtgggaggtgattggatcataggagcggatttcccccttgctgttctcatgatagtgagtgagttctcacaatatctgatggattaaaagtgtgtgcacctcccctcttgcactttctctccagtcaccatgtgaagttccttgcttccccttctgccatgattgtaagtttcctgaggcctcccagtcatgcttcttattaagcctgtggaattgtgagtcaattaagcctttttattcataaattatccagtctcaggtagatctttatagagtgtgaaaacagactaatgc

SEQ ID NO: 343868 - DNA, 1378 bp, Homo sapiens
  misc_feature (48)..(48): n is a, c, g, or t
ctgctttgtcccaaggatgaacacgtggcagccgaaaaaaaagttcanaggatctcaccctgtcgttcggctggagtgaagtggcgcgatctcagctcactgcaacctccgcctcctgggttcaagtaattctcctgcctcagcctcccaagtagttgggattacagagaaacagcccgaccacccaccctgacaaatgcctgaggcccacatgcagcctgcaaaactgcaaacatcactgcccaccacagaccacggaagcaagaagcctgtttcctgttacttgccaccactcagcaatgcccaccccatgtgtatagaggtccagaatgctcaaaattgttcttctgctgctgcaacattggagccttccatcatctcagacacatgcttttataaaccaataacaaaggatcaactttcttctaggtctgaattgaatactgtgaggctaaagtgtcttaactcattgagggggtggaaaatattaaaccaactaagccttacctaattacaatgccctgctgctgctcatctccctttattcgtttgtactcatactcaaaagaggttgtgtttttttcccttcattcaataacgattttccttgattcttagataagtccattccataatgtactccttaactgttctgaatttctttcagagaaaaactggaaaagacattaaatcatgttgaaatatttgactgactttcatctaggaaaaaatataaagttaaatctctacactaaaatataaacaaaataaaaagaaatttcagtaagaccaaaacatttacttttaaaaacctatatcatgttatatgtataactgaggaatgtaatcataattttgatttgtagaactgaagacaatatcaagtaaccctcaaaatgtaaattcaagaaacaaggtagttacgttagcctgcattaaaataaaaatatctgtgtgacaatatatgctgtagagcaaattaaaaaacaagtgaaaaggttgggtaaatatttgcaatacatattgatacggtttggatttgtgtccctgcccaaatcttatggcaaattggaggaggggcctggtgggaggtgattggatcataggagcggatttcccccttgctgttctcatgatagtgagtgagttctcacaatatctgatggattaaaagtgtgtgcacctcccctcttgcactttctctccagtcaccatgtgaagttccttgcttccccttctgccatgattgtaagtttcctgaggcctcccagtcatgcttcttattaagcctgtggaattgtgagtcaattaagcctttttattcataaattatccagtctcaggtagatctttatagagtgtgaaaacagactaatgc

SEQ ID NO: 343869 - DNA, 195 bp, Homo sapiens
cctatctatctatctatccatttctatcatccctatcatctatctctatacactattgattctgtttctctggatcaatcaatcaatcaatcatctatatatccatctatctatacactatttattctgtttctctggatctatctacctatctatctatcatctctatacactattgattctgtttctctgggt

SEQ ID NO: 343870 - DNA, 427 bp, Homo sapiens
cctagccccaaggtagccccttttctattggcacagctgctgacttcccccatgcaagcttccagcttgcttacgtatgtttgcagatcgatttttcgggctgctctttgttagaacaaaacgatattttgggcagctttttgttagaagggaagctctgcagaggagtttttgcccttactgtctgcctaaatagtttatttttacctcctgtataagttggatgtggcaagagtgacccaattgataagatgaacttttatcacggcagaattttaaattcactttacgtgcattctgcaagtaactagaaaagatactttttatttgcaaattataaggtgttttgtttgtttgtttgttgttatttgagacaatctcactgtgtcacccaggctggagtgcagtggtgcgatctcgactcact

SEQ ID NO: 343871 - DNA, 128 bp, Homo sapiens
atccaatttccacacacacacacacgcacgcacgcatcagaaaaccttgctgaaaactcatgtatctagcagaaattttttctttcaggcagcaataaatatgctttttttttttttttttttttttt

SEQ ID NO: 343872 - DNA, 382 bp, Homo sapiens
tgagccaagatcggaccactgcactccagcctgagtgacagagcaagactctgtctcaagaaaaaaaaaaaaattactgtattgcactgaagactatgaagaattcatgagaaccacaagagatcactttttattgccatacacaatttactgagagatgaactgctcctgggcatgtgtcacatggcattttacatagacactcccaacacttgaggcaccacaatagcaacaggaggtggctacaaagttattatagtagtacagaatgtactacagttagttttaaatagttatgatttaataatatgtctttacatgactggagtgtgaacggcaccatgtaaggtctgtatgtgtgtgcatagtattacatagtgtg

SEQ ID NO: 343873 - DNA, 714 bp, Homo sapiens
aggaaaaatgataagaacaaataaaataacattacatctttctttctaatatttataaatccaatttagttttacagcttaatagttggcctttccagattaaatttcagtgacagtaaaataaagatgatagtggtggattttttgtcattcagaggtataatttttatacagtgcaattaacagatctcaagtgtacagttcagtgagtttggcaaacccatactcgacataaaccacgtgtcagtcaagatatagaacatcaagaagagggtatgttctgctgttgcttgttccattcagctggaagacagctgttgcaggttctgttgccataggacatcccccaatcagaggaatatcagagtttcataaaaggcctgcagagccaatggaaccagatgtgacaaccagccctggcctttggcatccaccatacttcttccccctcctgaactcctgacctgatggggtgcttgttctttgggtgggtttatagatgacttcttggacaaagggttgactggcacagaggcggcaaagaggtagtgatcaatggagttctgtgggttcactccttattctccctcttccaaactctgtagtatgatgagaactagcgtgtgtgttttgaccctgcctgtgcatacattacagcatagggcagctgatattcccagggagatttaaagtcataggtctaaagaatagata

SEQ ID NO: 343874 - DNA, 366 bp, Homo sapiens
taatataatcttagcctagttagaattaacctatgtatatacattgtgtacttaataaagttggccctgagaatgttcactaattcagaattggccttttccctcaattaatttgaaatctgttctttatttaagcaagtttttgcaccagtgtgtaaccttaaacacatttaagacatataagttctttagaaaaactatatggccaatatttaattgaaacaaaatatacttggggtaggtgggaattttcatgtggaaacttggacttttcataggaaggttatagggtggttgatccctgatggctggttaagaagacctgaaaatatcttcgcattcccacttcctactcaaaactgcact

SEQ ID NO: 343875 - DNA, 230 bp, Homo sapiens
atttaagctttttgggcacttcccatgggaagctgtccctaccaaagtggccataggctgcagtcctctgataaattggcttcttcagatccagatcccttggaatatacaagttccgtaacttatatatgtacgcattaaattcaaaataatagcaaaacaattcagcaagactcattttcaagtagctctgagcaaactgagttctctgggcatatgctagcgaagga

SEQ ID NO: 343876 - DNA, 313 bp, Homo sapiens
tgctgggattataggcgtgagccaccacgcccagcctctccgctgtttctaagatacagaaatttcaccatattagctttcttgaccactttatataaaataggaaccccttccctagcttgcctaagtatttctatctcccttatactgtttatttttcttcaaagaacttattgccatctgacatattatatacttctttctatatttatttacatgtcctttcccactatcatgtaagatcattgagtgtggggaatttttctatgagaaaatggggcatatagttagtgttttagaagtattgaatgga

SEQ ID NO: 343877 - DNA, 865 bp, Homo sapiens
cccagtagagttataaaatagaaacttcattttttcctcatgactgcttctgtaaacccactagctcagtcttttctccctatcctgaatggactcttgcagggaagtcccataaattgttgtttttttttccagtcactcaggtaataagtcctttggtcactttaagttacagacattaattttagtaattaagatgtctgtgtcattagctatacattttctttaaagctaagctcagacttgtttaagtccacaatgggaaaggggtttgatggcagagactgctaggtgtctaccaaagattcttgctctttgaagatatgttgtcaagatgtggcaatccagccagggacatttccctactcccagcatctctgtgagaacatatgactaagtcgtaggcggtgaaatgtgggcataggaatccaggcttgccccataaacatttcttgcatgatcctccattctcttctcccagctgctggttggacggtcgtatccaggataagtttggaagccaccgaagatggcaaagattgtcagtctggttctttgaatgaccgtgaggactaagtcttcctttcagtaactccactctgcccctagctaattggactttatatgagcactttcttctcttcttcccccgactgtccatctgctcttccaccaaggtgttagtggagagttgaccttgtgtctgaggatctctgcctgccgttttcttaatgtaggcccgtggttcttaaagtgtgtggtcctggaccagcagcattggtatcacttggggacttactagaaataaaagttttagtataatccgtaggttcagaaaaataaaaaataaatgagggttctctgg

SEQ ID NO: 343878 - DNA, 466 bp, Homo sapiens
gtcacacttgcccagtggggccaaagccacctctcaggggctggtggttcagggaggattcaggcatttactcagaggcaccactcagaaaattggcattaagaaaatgactactagaaggtcagcctctggatactcatagaagttctggaaaagctgtgtgtttagaagacagccgagcccagcacggccccaggacgcattaccaatgggtcaggggtgggccttcagaggcgagccgctgacctcccttaggagagggaacagatggcatttcacagctgctgaggtcaggctccaggaggagaagtcagtctcgcagccgtggaaatgctgagactggacaggtgtgatggttcttcccaggcacgagactcattcgttcttaatgggctgcttagtgaatcttatgacttcagtaatttcttcctgggctccacattcactggactgcactgaaatggag

SEQ ID NO: 343879 - DNA, 526 bp, Homo sapiens
ctgagaactgcttgaggtcacggataatgcttctgtctttttatagaaatcacttccccacccagaccttagtaatgtagacagtagacataaaacatatcattacatacatgaatgggcaaatgataacctgtatcatagaatgtacaatacatctgccctggcatgtaacacttttaaagaaaactaaacattgacatccaacatattaaatgcaacttaggaaacaccaatgatgcatttttaaagacttaatcacagtacgatgatttaatgaaaaacaagaagagaatgttatattttatcgtttcgtatctcagcagtttggcactggattcagttgataggaacagcaacatggcaaaagttgaaaggaaactgtttggcctgggtgattttttgtctttcaggcagagtaatgagtaaatacaaaatcacctctggtgagacacagtccactggtgtttatgtcatgtcatttcattaactgacaaacagaattactgcctctcccttccccaaacct

SEQ ID NO: 343880 - DNA, 334 bp, Homo sapiens
gtagagacggggttttaccatgttgcctaggctagtctgaaactcctggactcaagcaattcgctcactttggcctcacagagtgctaggattataggggtaagccacagtgcccggccagtaaaaataatctacatacaaatggcttcaaatcttggtaataagaagagtaaatttgaataatacttcatagataaccaagtactctgacacagatcatttattcacttattgccgtgacaggcccatgtggcagacattatttttagtcccccaatttggactaaaggaaatgatgatcaaatgatttgtccaaggtcacacaacagagtag

SEQ ID NO: 343881 - DNA, 582 bp, Homo sapiens
aatttttctggcacttcctgggttgtcttcctttctcatatttctacaactttacacctgttctttcctcctctgtagggttatttcaaatgtcactaaaagtaacagctcttctgctatcaccagggatgctgcattttctgtaggattaaatccctaatcttaatcaaaaagtgatgacacatttcataatgaaatgtgacctgtctttcctcaattctagcaccaccaccacctcactgcctgctgccttgcacaccctacatatcacactccgtgactgtacttaagagaacacattctggctgggcacggtggctcacgcctgcaatcctagcactttgggaggctgatgcaggtggattgactgagctcaggagttcaagaccatcctgggcaacatggtgaaactctgtctctattaaaatacaaaaaattaactgggcatggctgtttgtccctgcagtcccagctactcagaaggctgagtaggagaactgcctgaacccaggagatggaggttgcagtgagccgagattgcaccactgcactccaccctgggcaacagagggagactccgtc

SEQ ID NO: 343882 - DNA, 528 bp, Homo sapiens
aatttttctggcacttcctgggttgtcttcctttctcatatttctacaactttacacctgttctttcctcctctgtagggttatttcaaatgtcactaaaagtaacagctcttctgctatcaccagggatgctgcattttctgtaggattaaatccctaatcttaatcacaccaccaccacctcactgcctgctgccttgcacaccctacatatcacactccgtgactgtacttaagagaacacattctggctgggcacggtggctcacgcctgcaatcctagcactttgggaggctgatgcaggtggattgactgagctcaggagttcaagaccatcctgggcaacatggtgaaactctgtctctattaaaatacaaaaaattaactgggcatggctgtttgtccctgcagtcccagctactcagaaggctgagtaggagaactgcctgaacccaggagatggaggttgcagtgagccgagattgcaccactgcactccaccctgggcaacagagggagactccgtc

SEQ ID NO: 343883 - DNA, 393 bp, Homo sapiens
ggtgttattacctcccacagaatttttctggcacttcctgggttgtcttcctttctcatatttctacaactttacacctgttctttcctcctctgtagggttatttcaaatgtcactaaaagtaacagctcttctgctatcaccagggatgctgcattttctgtaggattaaatccctaatcttaatcaaaaagtgatgacacatttcataatgaaatgtgacctgtctttcctcaattctagcaccaccaccacctcactgcctgctgccttgcacaccctacatatcacactccgtgactgtacttaagagaacacattctggctgggcacggtggctcacgcctgcaatcctagcactttgggaggctgatgcaggtggattgactgagc

SEQ ID NO: 343884 - DNA, 500 bp, Homo sapiens
atatggggtcccactgtgttgcccaggcttgcctcaaactcctggactcaagcaatccttctgccttggcctcccaaagtgctgtgactataggtgtgagccacttcacccagccttccctttttatcttgaataatattccttgccttaaattctattttgtttcatattggttgcatgttatacattttccattcttttacttttctatattcttctatataaggaaaatctcttgaaagtagcatattttttttttttccaatctggcgatctttagcttttaattagagtacttactttgctgacatttcatgtaattacaaatatatttgggtttaaatctatcatcttactacctttttttaaattatactttaagttctggggtacatgtgcagaatgtgcaggttacataggtatacataggtatacacgtgccatggtgatttgctgcacccatctaccctaatacctatgtcatctacattaggtatttc

SEQ ID NO: 343885 - DNA, 150 bp, Homo sapiens
aaaaaaaaaaaaaaaaaagtgatttagtcttataaaggggatcatttcacgacctcaaagtctgagtcactttacatggtaattaaaatgaacccattgcactgaatcttccatggtagaaaacagtaatatggtatctcccctattgtt

SEQ ID NO: 343886 - DNA, 990 bp, Homo sapiens
cacaatgagacaaagatgtgattgacatgaagaccccacagctgataacaggcaaaaaacctgatagttattttaatataagtaaatgatacaatttactacatatacatggctatctagaacaaagttagagacaaagttaggatgtggtgggtgagtttccccagcctccatctatagtggggtgcccagccactggtggtattgcctaattggagtgaggattctagccagtctttctgaaatgccttgcattcatcctcacagagttctagccctttccactatgcctgcccactagctgtatataattaggaacactccagaacagtggtgctgccttgtagactgagtgaactgggatttggtttcccagtcattttctcagccttttaccgtgtttaggtaccaggcctgtttgtaaagtagtattgcttaggccagcaaaaattaggggcaaaaagagatgccttgagcttggataatttagaatggagttgcttctccttaagtggccacaaattaatactgtttttcactgattaaggtttttgtaggacatatatttagggtgtcatagtctgagggatacgaagaacttaaagatggcactaaattagaaaatgaaagtggttaaattggaaatttgcagttatttgagaatgggtctttcaaaggtgttaagtctgaggtcatttgttttatatgctttagtttatcagtttgtcagagattgattatttcttttatcattcctgggcagaataaggaatatttggaatatagatgttcaaggagaaattttctaataagaagaactattaaaaacactggatttgtttgatggcaaggagttaaccaaatttgttagtttccatacaactttttcttccccccaaagaaacttgtagtatatgtaaaccgaatcttcactgtggtagacagtaatgattatctgtttagtaaagggaaatgatgatgtacacattg

SEQ ID NO: 343887 - DNA, 281 bp, Homo sapiens
acaatcaaactttttaacaatgaatcacagaaagtgttatgatttgggaatggcagaatatcatggcatacaaagctggaatgcttgactcaagatagcatgatagggaagacttcctgaagaaacagcatcaaacctgagactggaaagatacataggcattagtcaggagaagttaagtatccacctggcctaattccccaactagaatagtttctggaacccagcctttaaaatgcttcattctatttgattcagtgttaaaaagttggtttgcttcc

SEQ ID NO: 343888 - DNA, 448 bp, Homo sapiens
acttgtttcttcagaatgtaggattgtttgtcctgctttttcagtgcccaactattattttcatgaatgtctttcactgttattgattggcaaacaagtcaaatcctaaaactacagagtaacaggctaatcccagctctattccccattagcaagagcacgtccttgctctccaaccagagtgagaaggcaaatatgctactcccactcagattgagcacattatttacattctctgttgggggttgaatgagttatatcactaggaaaattaattcctgcacttcccattttacttacagagtttgttggtgcttgtggaaagagtaaaattacaaatcctgataagttaatggcagagaccctgtgtaaatttgtttggaaattttcttcatctaatcatatcacctttagatgtgcatggtcagtgtgtagagctgcacttctt

SEQ ID NO: 343889 - DNA, 207 bp, Homo sapiens
atattcaaaaggcagctaattcattcctctcatttgacaaatgaggaagctaagaacaagagagagggttatgaagctattagtgacaaggaaggattagaatgtaagtctctaaactcccaggctagtgtcctttataataatttataagaagggagttcttttgttttttttttcttttgtggcctttatagccatcttgctgct

SEQ ID NO: 343890 - DNA, 547 bp, Homo sapiens
agtaataaaccagctgtgttagaaatggatcacttatcagtgcgtgcccaagcctcctaatgcctcatgatgtttaataattaaattgtgacaccttgaacccgcagctgacaccatgaatcacagtggaattctccaaatggaatgcagccacacctcagcttctgtgctgcgtgctgccactgaggacattcgataccattgaagccgtcagatagaggccgtatttcaaaaggtctacggtggctccgtttcttctctgagacttcaaaagtccttcaagagtgagttcccgtctcattctatgtccaggatgaagacggatggcctcttggcacccatctctttggcatgaacgatgtggggaaacgtgaatggaaatggggaactgttgctggcacccagaagtcatccggtccggatgaagccaagtcacaaggaagtgcctccaattattcttcataaattcctctgaggtttcacttcttgtccacacaagactttaataaaatgtggcatctaactgaataaagactatcctttcggg

SEQ ID NO: 343891 - DNA, 408 bp, Homo sapiens
tgccgggtctcagctctgctcacccgcgcagctcccagaaacttccccggcttgtctccactggaatcgggatggaagggagccacggctggctcagcccctctcggagcagaaagaggaaacttctgaaaagaagatgggggctgggggaggacatcaatcagcacggacaagatgaagacggatggcctcttggcacccatctctttggcatgaacgatgtggggaaacgtgaatggaaatggggaactgttgctggcacccagaagtcatccggtccggatgaagccaagtcacaaggaagtgcctccaattattcttcataaattcctctgaggtttcacttcttgtccacacaagactttaataaaatgtggcatctaactgaataaagactatcctttcggg

SEQ ID NO: 343892 - DNA, 589 bp, Homo sapiens
cggaatattcttagatagctcagagaatcctgaaagaccatgtttattatgtattactattgtacttttaagtaacttaatcaaaaatcagagtacagagtaggtccatggtttctgcatccatgaattcaaccagacttgggctgaaaatatttttttttaaatgtgtctgcactgaacacgtacagactctttttttcttgtcattactccctaaacagtacaatttacatagcatttgcactgtattaggtatctcagaaaatcatcaacttcatcaaattcatcaacttagaaatgcatgtgctgcttccaccaactgtaaaatcaaattcaacaagaccagttcccataaattagaatctcaatccatgaagaaaacccctcctgagtgatggaagcaccagcagctttgtagcaggacttggggccatagccgagcacagaaagcaactcctccctcgacacccgggcatcaccagctggagcccagaggaacacaaagctccctcccgggcttgcacgtttgctcattccctatcttgccatctggaacaggcagaaagaaggaagtcatcacctgcgacta

SEQ ID NO: 343893 - DNA, 447 bp, Homo sapiens
aatgacacatgagccataccttatatcacacacaaaaatcaattattgatagggtgaactaaatatatctatacagtggaatactgttcaatgacaaaatggaatgaactaatgatacatggtacatatcatgggtgaacaacaaaaacatgctaagtgaaagaacctaaacccaaacactatcagactccataatatatgcaatttctttaaaaaggcagatccaagaagaaagaaagcagatcagtggttgcttgggtagaacaagaattgactgcaaacaagcttggggaaactttttaagtgatggaaatgttctagaactgaaatgtggtgatgggtatacaattctgtaaacttagtaaaaagcacccagctaccagcaggtgagttttatatgtaaattatacctcaataaagttgatccaattgtgaaagacaaactta

SEQ ID NO: 343894 - DNA, 206 bp, Homo sapiens
tgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatca

SEQ ID NO: 343895 - DNA, 586 bp, Homo sapiens
tgggcacatattaagtgctagagaaagttgaaggaatgaatgaattatacagttaaaatttcacaattgtggtaagtcctggaaaggacaaataagggttgtttgctctgagaacaaactttaacacaacttgaccaaggctgggattattggagggctggtctggggaagtgatgcttaagttgagacccaatgggctggtatcacacagaaagccttcacaactcaggggagcagtgtgtgcaaaggccctgaggtggaaaggagcacagtatgttctaggatctgaaagggagaactcaaagcaagaaggagaaagattctagaagacgctggtgaggcaggctggaggctgacccggaaagaccttcaggagatgtggaagagtttggagtaatgagaagccattttaagtacaggaatgattccatcgaatttgtgtaagatcagtctggccgctgggtggaggctttctaagatggggttgaagagggatggggaggagtaaggaaggctgtagaatgaccaggagtccacaggaggcaatataggctagggcgctggggtaccgagctgattgtatcag

SEQ ID NO: 343896 - DNA, 279 bp, Homo sapiens
caggcatcagagcttcactgagcccagtttggctaatgagaagttggaagacatcaacaagggtctagagttcagaacactgtcactattcagatggaagcacctagttaaactgacagtcctcctggctgacaccacaagcctttttctgccatttcactaactttctgagagagcaggtgtttttatcattgtcttccagtgtagacaaattggtttcatcacctaataatcatcgcttttataagaggaatgtctggatggagatcagtttcaatg

SEQ ID NO: 343897 - DNA, 252 bp, Homo sapiens
ttccctctgcgttctacttttgacaaagctaaacttggttcctagtactccacacagtcctcttggcccagcctgctttgctctctggcctttctggaagttcctgggcactttttgtctgacacttcattgacagtcactcatacagtggcttcccggcaatgtttcctcaaaaagagcaaatctcttatacagaagcagtacaggtttattaccaacattttagagaataaatagaagaagaaaaaactt

SEQ ID NO: 343898 - DNA, 265 bp, Homo sapiens
gtaacacaagacatagtggaaaacaagtgagatgacagagatcttacctttatggaacttacaaacacatgaatttgccttttcattttgggaggtctgtggaccctatcccttccccaaccatcagggataagtatatgagtctcatctcagctcaaaaccttgctctgtggttcacgcctgtaatcccagcactttgggaggccgaggtgggcacatcacaaggtcaggagatcgagaccatcctggctaacgtggtgaaacc

SEQ ID NO: 343899 - DNA, 110 bp, Homo sapiens
gtccgtgggtccgagctctcggagtgtgattctgtctcccctagaaacacatcatggcgtgtcctcagggcatttgtgcgcgggatttaagcagatgtttcctcaccgtg

SEQ ID NO: 343900 - DNA, 398 bp, Homo sapiens
atagccaacacaatccaatgacattttaaagtcaccaacatttcaaacttatgtattaaaaaatatagacactgggccgggtgcagcagctcacgcctataatcccaccactttgcgaagccgaggggtgtggatcacctgaggttcggagtttgagaccagcctgacaaacacggagaaaccctgtttctattaaaaatacaaaattagccgggcatggtggcacatgcctgcaatcccagctacttgggaggctgaggcgggcagttcacgaggtcaggagattgagaccatcctggctaacacggtgaaaccccgtctctactaaaaatacaaaagaactgggcatggtggtgtgcacctgtagtcccagctattcgggaggctatcagcgcgtt

SEQ ID NO: 343901 - DNA, 384 bp, Homo sapiens
ttcttcctactccttcactcccacatataatcaattagttcttttgactgaacctcctaaacagtcctagaatttttcagcttatctctatctccactgtcacatctccaaattcatgacattaccatcttcgattgtgtaaatcagttgccacacatgtgatgttcctgcctccaatatagtctttttgggtccattctttgcactgtagccagaggatctaatacccaaagctgatctcatcccatcctacttaaaacccttcaatgactccatattgccctcagaatgaagtccaaattcttacatgtacaaagtctgatttacaaagtcttgtattcccaaagcaggctgaaagactgttgcaggttgagtttcccagga

SEQ ID NO: 343902 - DNA, 684 bp, Homo sapiens
taatcaagactatagtactttttctggcattgatgaagctgctattctaggagaccatagtatgccctcaagtttctatttgttcagcatgtgcatagtacacagtatctgcaaaggcattgagatatgtggcgatattgcagtcttgttgggggtgggggtgaggagtagaacaccaaatattgaaatcatgataaaaggtagtacattactgagattctgagaagggggattctgagaaggaggtcacgataaactgcagtgattaggcatccttcatggtggtagcatagctgcgaactgaaccttcaaggcaaattggagaagaaaaacattcaggcctaaagaagaccagaaagagcaagtgctcagtcttctgagagaatatttttgtgtgctgtaattgacagtggttccatgtatacagaacaaaaaattgtcatattagactgaagctggctgtgttgatccaaagaaagcgtaggaaagcatcctgaatatactattgcctgttttcctgactcataaatagcatatcctttattctccaaatgcttaggactcttaaactagcaaagcatatactttgaagtttataaacgtatagatgtgtttgcaagtttttcctttttatctgagaattcataacatgataaactttatttctgtgtaagagaatggaaa

SEQ ID NO: 343903 - DNA, 313 bp, Homo sapiens
gagttgtgtacatatgtaccaataagtaatttaaaaaatggcaatcaacacatataaaattgcttaaccacaccaaaacttaaatctaatcaaaagcattgaggcatcaatgtgaactgattttgataaggatatacatatgtcacattttaaaatataaatgagcccacataaagaaatctggagaatatttacaaatcaattgggtgattatcttgagacaggacacattaaggaggagatacaagataatgcctcttatgattatatatttctccagtgtttttctttcttttaacttttattttaggtt

SEQ ID NO: 343904 - DNA, 3898 bp, Homo sapiens
  misc_feature (1616)..(1616): n is a, c, g, or t
  misc_feature (3700)..(3700): n is a, c, g, or t
tcctaagagggcaagcgggtggtactttctgtattttaatattgtgttagaatctgggacatctgattgctgaaatgagatgttagttggtacagggaggggtttccaggacccgcacgcccttgcggagtgcctgctggagggagccggtgtgtccaggacacccttgcggagtgtctgctggagggagccagtgtgtcagtgagatggctatgcccctgggctgctgtgtcccaggtttcctcagtctctaaccctttgttctcacaggggatggactcttgcttcttttcccaactccaccaagagggaccgtcccaggacgtccttccccgggcatctggccctacagctgcctgaggtctccatcaccgttggcgccatcagtctgctgtgcagccagctgttggtttggagagcctgaagaactgcagttcacgtctcatctaaaggagctgaaatgatattgcagctttttcttttggttgcgtgcagtgagaatctgggagctgaacctgttatctgcatggtcttcagaaatcaggcaaactcggaaaatgccaacgccaaaaatgctgatgggtgacaaagtgtcacaggtgtgatgcattacaaatctcaggacttttgttcactggatttgacaggtcaagcttcacaggaaaatgatgaagtcccaaaagaccagaaatatatttcagaagatgccagttactactttaaatgtcaaaccaacatttcagaaataactttcaatgattatttcctgccaagaaggtgaacgctggagaccttaatggtggaagatggagggcgtctttccttctgttaagctgacaacttggcttccatcttgtgaggacctcaccctacctggtggcagaggacgtctgacgccctcaatcattgccattacacttcccagcctggtggtcagtctcctggggtctgtgtgttaacaaaccatcgactggacaatcgcagttttccttatgaaggcttactttaaaaaggctctggattttcagaagcgaagtcgctttcatccccgattcagacccatcctagtggaggaaaaatcctaccagaagaagggctgaccataggaacttgccatttccttgaccccatcatatctgaggaaaaaacaacagaaaaggtcaaaacccacgtgtacgcccaacgtcctgattgacgactttgcctgcagcttctgctttcctgaaattcgctgctgcctttagaacccttgtctgcagccagtggggagttcaggacttaggcggagctgccccaccctcctgcttggcaccctgcaaatacatgccctcccttccatcgctgcagacctcagagtgggcgtccggtctcctgtgcgggatgagaatacacaccctcccttccatcgctgcagaccttagagtggatgtccggtctcctgtatgggatgagaatacacgccttcccttccatcgctgcagagtggacgtctggtctcctgtgtgggataatacacgccctcctttcaatcgctgcagacctcagagtggacgtccggtctcctgtgtgggataatacacgccctcctttcaatcgctgcggacctcagagtggangtccggtctcctgtatgggatgagatacactccttcccttccactgctgcagacctcagagtggacgtccggtctcctgtgtgggatgagatacactccttcccttccactgctgcagacctcagagtggacgtccggtctcctttgtgggatgagaatacactccttcccttccatcactgcagacctcagagtggacgtccggtctcctgtgcgggacaagaatacactccttcccttccatcactgcagacctcagagtggacgtccagtctcctgtgcgggatgagatacactccttcccttccatcgctgcagacctcagagtggacgtccagtctctctgtgcgggccaagtgtacacagttttgttccgtcacaacttccacgacaggccagtgtgaggtttttgagctggtgctgactgaaaactgtcagctgcccaaggacctgggagctctgctccccactcctggtgtgcggtcttgcgcctggcctccctgcctaggttacatgcagtggtcatcccggtcgctcccacacccgtgtgggctctgggatcccctcttccagccagcccaggggacatctggctgtctcaggacccagccatctgtaaaaattaggcaggtcccttcagtatgctcctggtcaacaaagaaaaacttcaattttgagaatggcatctgtattccgaagtgttctctcagatgtttgagttccactaagtagattttcttagtctgctgtatcaatgacacagagagacgtgcattaaaacctcaaccatgtggatctatttcttttcagttaattttgcttcatgtatcttgaagctctgttatcaggtgcatgcacatttgggattgttatgctttcctgatgaactgaccttctttcattatgcaaggggaagaagatgctgcatacaggatggaatatccaggggaagacgtctaaggagagatgcccagctgggagtcctatgcaaggggaagaagatgctgcatacaggatgggatatccaggggaagatttctaagaagagatgcccagctgggagtcctatgcaaggggaagaagatgctgcatacaggatgggatatccaggggaagatttctaaggagagacacccggctggaagtcaagatatgtcagttgtttccattataataaaaccactcatgttagatgagctgaactttcccttttccccagttcttacgatcaaaaagtggctgtcctaaatttcatcactcaatatccttgctagagtcttcctttgtcagccaggctggagtgcaatgtgcaatggcacaatcttggctcactgcaacctctgtctcctgggctcaagcaattcttctgcctcagcctcctgagtagctgggattacaggtatgcaccaccatgcccaactaatttttgtatttcagtagagacgaggtttcaccatgttggccaggctggtctcgatctcctgacctcaggtaatctgcccaccttggcctctcaaagtgctgggattacagacatgagccatcatgcctggacataagtgagttttatattgtattataagactatgatacagtaaaaccatgaaatccaaatttataatatcacactacataatacaactgtaacctcaccgccctatcctgggatgtgtgtcatttttatagccaattatggcccccagctttagttttcttttgcttattggagagtgtaattctcccttattctttttgctttctacagtcttgtgtacatcagttatctgtttttgtccttttgccagtgttcaaagtgttatttttcgtatttacttaagctcctgcagggagattagaatttcttcccctaagaagaaataagtaatagcggagacctgctgggcactggtggcgccaggcttggctctggggctgcccatccatcctcacagcatggcgactggagggtcttgccctgaggtcccgtgtgcggagcagggcttggcattcactcctaggcactgctgactcagtctgtcctggtggtgctgggaggccgaaacccgtcatgcatgtaaaccgcngggccccgtctggcatggtgcacctgtgctgggagtgcctatagagtaggaaaagtattcctggacctttaaaaaacttaggccaaaaaagtgttttggttgaatctttggccaaattggaactgcaaactctgtattatctccccttttgtgaaattctatggaaaattcgagcaaataaatatgcatttcccagtg

SEQ ID NO: 343905 - DNA, 2814 bp, Homo sapiens
  misc_feature (1616)..(1616): n is a, c, g, or t
tcctaagagggcaagcgggtggtactttctgtattttaatattgtgttagaatctgggacatctgattgctgaaatgagatgttagttggtacagggaggggtttccaggacccgcacgcccttgcggagtgcctgctggagggagccggtgtgtccaggacacccttgcggagtgtctgctggagggagccagtgtgtcagtgagatggctatgcccctgggctgctgtgtcccaggtttcctcagtctctaaccctttgttctcacaggggatggactcttgcttcttttcccaactccaccaagagggaccgtcccaggacgtccttccccgggcatctggccctacagctgcctgaggtctccatcaccgttggcgccatcagtctgctgtgcagccagctgttggtttggagagcctgaagaactgcagttcacgtctcatctaaaggagctgaaatgatattgcagctttttcttttggttgcgtgcagtgagaatctgggagctgaacctgttatctgcatggtcttcagaaatcaggcaaactcggaaaatgccaacgccaaaaatgctgatgggtgacaaagtgtcacaggtgtgatgcattacaaatctcaggacttttgttcactggatttgacaggtcaagcttcacaggaaaatgatgaagtcccaaaagaccagaaatatatttcagaagatgccagttactactttaaatgtcaaaccaacatttcagaaataactttcaatgattatttcctgccaagaaggtgaacgctggagaccttaatggtggaagatggagggcgtctttccttctgttaagctgacaacttggcttccatcttgtgaggacctcaccctacctggtggcagaggacgtctgacgccctcaatcattgccattacacttcccagcctggtggtcagtctcctggggtctgtgtgttaacaaaccatcgactggacaatcgcagttttccttatgaaggcttactttaaaaaggctctggattttcagaagcgaagtcgctttcatccccgattcagacccatcctagtggaggaaaaatcctaccagaagaagggctgaccataggaacttgccatttccttgaccccatcatatctgaggaaaaaacaacagaaaaggtcaaaacccacgtgtacgcccaacgtcctgattgacgactttgcctgcagcttctgctttcctgaaattcgctgctgcctttagaacccttgtctgcagccagtggggagttcaggacttaggcggagctgccccaccctcctgcttggcaccctgcaaatacatgccctcccttccatcgctgcagacctcagagtgggcgtccggtctcctgtgcgggatgagaatacacaccctcccttccatcgctgcagaccttagagtggatgtccggtctcctgtatgggatgagaatacacgccttcccttccatcgctgcagagtggacgtctggtctcctgtgtgggataatacacgccctcctttcaatcgctgcagacctcagagtggacgtccggtctcctgtgtgggataatacacgccctcctttcaatcgctgcggacctcagagtggangtccggtctcctgtatgggatgagatacactccttcccttccactgctgcagacctcagagtggacgtccggtctcctgtgtgggatgagatacactccttcccttccactgctgcagacctcagagtggacgtccggtctcctttgtgggatgagaatacactccttcccttccatcactgcagacctcagagtggacgtccggtctcctgtgcgggacaagaatacactccttcccttccatcactgcagacctcagagtggacgtccagtctcctgtgcgggatgagatacactccttcccttccatcgctgcagacctcagagtggacgtccagtctctctgtgcgggccaagtgtacacagttttgttccgtcacaacttccacgacaggccagtgtgaggtttttgagctggtgctgactgaaaactgtcagctgcccaaggacctgggagctctgctccccactcctggtgtgcggtcttgcgcctggcctccctgcctaggttacatgcagtggtcatcccggtcgctcccacacccgtgtgggctctgggatcccctcttccagccagcccaggggacatctggctgtctcaggacccagccatctgtaaaaattaggcaggtcccttcagtatgctcctggtcaacaaagaaaaacttcaattttgagaatggcatctgtattccgaagtgttctctcagatgtttgagttccactaagtagattttcttagtctgctgtatcaatgacacagagagacgtgcattaaaacctcaaccatgtggatctatttcttttcagttaattttgcttcatgtatcttgaagctctgttatcaggtgcatgcacatttgggattgttatgctttcctgatgaactgaccttctttcattatgcaaggggaagaagatgctgcatacaggatggaatatccaggggaagacgtctaaggagagatgcccagctgggagtcctatgcaaggggaagaagatgctgcatacaggatgggatatccaggggaagatttctaagaagagatgcccagctgggagtcctatgcaaggggaagaagatgctgcatacaggatgggatatccaggggaagatttctaaggagagacacccggctggaagtcaagatatgtcagttgtttccattataataaaaccactcatgttagatgagc

SEQ ID NO: 343906 - DNA, 3279 bp, Homo sapiens
  misc_feature (1175)..(1175): n is a, c, g, or t
  misc_feature (3081)..(3081): n is a, c, g, or t
ccacgcgtcgcggacgcgtgggtcgacccacgcgttcgcccacgcgtccggaagtgagaatctgggagctgaacctgttatctgcatggtcttcagaaatcaggcaaactcggaaaatgccaacgccaaaaatgctgatgggtgacaaagtgtcacaggtgtgatgcattacaaatctcaggacttttgttcactggatttgacaggtcaagcttcacaggaaaatgatgaagtcccaaaagaccagaaatatatttcagaagatgccagttactactttaaatgtcaaaccaacatttcagaaataactttcaatgattatttcctgccaagaaggtgaacgctggagaccttaatggtggaagatggagggcgtctttccttctgttaagctgacaacttggcttccatcttgtgaggacctcaccctacctggtggcagaggacgtctgacgccctcaatcattgccattacacttcccagcctggtggtcagtctcctggggtctgtgtgttaacaaaccatcgactggacaatcgcagttttccttatgaaggcttactttaaaaaggctctggattttcagaagcgaagtcgctttcatccccgattcagacccatcctagtggaggaaaaatcctaccagaagaagggctgaccataggaacttgccatttccttgaccccatcatatctgaggaaaaaacaacagaaaaggtcaaaacccacgtgtacgcccaacgtcctgattgacgactttgcctgcagcttctgctttcctgaaattcgctgctgcctttagaacccttgtctgcagccagtggggagttcaggacttaggcggagctgccccaccctcctgcttggcaccctgcaaatacatgccctcccttccatcgctgcagacctcagagtgggcgtccggtctcctgtgcgggatgagaatacacaccctcccttccatcgctgcagaccttagagtggatgtccggtctcctgtatgggatgagaatacacgccttcccttccatcgctgcagagtggacgtctggtctcctgtgtgggataatacacgccctcctttcaatcgctgcagacctcagagtggacgtccggtctcctgtgtgggataatacacgccctcctttcaatcgctgcggacctcagagtggangtccggtctcctgtatgggatgagatacactccttcccttccactgctgcagacctcagagtggacgtccggtctcctgtgtgggatgagatacactccttcccttccactgctgcagacctcagagtggacgtccggtctcctttgtgggatgagaatacactccttcccttccatcactgcagacctcagagtggacgtccggtctcctgtgcgggacaagaatacactccttcccttccatcactgcagacctcagagtggacgtccagtctcctgtgcgggatgagatacactccttcccttccatcgctgcagacctcagagtggacgtccagtctctctgtgcgggccaagtgtacacagttttgttccgtcacaacttccacgacaggccagtgtgaggtttttgagctggtgctgactgaaaactgtcagctgcccaaggacctgggagctctgctccccactcctggtgtgcggtcttgcgcctggcctccctgcctaggttacatgcagtggtcatcccggtcgctcccacacccgtgtgggctctgggatcccctcttccagccagcccaggggacatctggctgtctcaggacccagccatctgtaaaaattaggcaggtcccttcagtatgctcctggtcaacaaagaaaaacttcaattttgagaatggcatctgtattccgaagtgttctctcagatgtttgagttccactaagtaggggaagaagatgctgcatacaggatggaatatccaggggaagacgtctaaggagagatgcccagctgggagtcctatgcaaggggaagaagatgctgcatacaggatgggatatccaggggaagatttctaagaagagatgcccagctgggagtcctatgcaaggggaagaagatgctgcatacaggatgggatatccaggggaagatttctaaggagagacacccggctggaagtcaagatatgtcagttgtttccattataataaaaccactcatgttagatgagctgaactttcccttttccccagttcttacgatcaaaaagtggctgtcctaaatttcatcactcaatatccttgctagagtcttcctttgtcagccaggctggagtgcaatgtgcaatggcacaatcttggctcactgcaacctctgtctcctgggctcaagcaattcttctgcctcagcctcctgagtagctgggattacaggtatgcaccaccatgcccaactaatttttgtatttcagtagagacgaggtttcaccatgttggccaggctggtctcgatctcctgacctcaggtaatctgcccaccttggcctctcaaagtgctgggattacagacatgagccatcatgcctggacataagtgagttttatattgtattataagactatgatacagtaaaaccatgaaatccaaatttataatatcacactacataatacaactgtaacctcaccgccctatcctgggatgtgtgtcatttttatagccaattatggcccccagctttagttttcttttgcttattggagagtgtaattctcccttattctttttgctttctacagtcttgtgtacatcagttatctgtttttgtccttttgccagtgttcaaagtgttatttttcgtatttacttaagctcctgcagggagattagaatttcttcccctaagaagaaataagtaatagcggagacctgctgggcactggtggcgccaggcttggctctggggctgcccatccatcctcacagcatggcgactggagggtcttgccctgaggtcccgtgtgcggagcagggcttggcattcactcctaggcactgctgactcagtctgtcctggtggtgctgggaggccgaaacccgtcatgcatgtaaaccgcngggccccgtctggcatggtgcacctgtgctgggagtgcctatagagtaggaaaagtattcctggacctttaaaaaacttaggccaaaaaagtgttttggttgaatctttggccaaattggaactgcaaactctgtattatctccccttttgtgaaattctatggaaaattcgagcaaataaatatgcatttcccagtg

SEQ ID NO: 343907 - DNA, 551 bp, Homo sapiens
caggtcccttcagtatgctcctggtcaacaaagaaaaacttcaattttgagaatggcatctgtattccgaagtgttctctcagatgtttgagttccactaagtaggtaggaagtggcagtgttgctgtttaatggattggtaatttttgaatatttcttaaacatttttatttgtgtttttttggattgaaatttatgtaatttgttactatctgttagactcttggtgtttctcttactgactcaaccataagaatactaactccttttcgtatttcttgcatatatttttccatattactgtttcccttttgatttagcttgtggtttctgacatggtttctcagtctcactctcctccacattctgtctactctcaacccctcacccatcatgtctcggcttctgtcccctttatgcttcaatctcatcccctccactgtgtctgtgtcatcactacagtgtgtctcagccttagctcccccactgtgtctgtcccaactccccattttatctcagtctcaccccacattgtgtctcagtctcacccc

SEQ ID NO: 343908 - DNA, 3720 bp, Homo sapiens
  misc_feature (1616)..(1616): n is a, c, g, or t
  misc_feature (3522)..(3522): n is a, c, g, or t
tcctaagagggcaagcgggtggtactttctgtattttaatattgtgttagaatctgggacatctgattgctgaaatgagatgttagttggtacagggaggggtttccaggacccgcacgcccttgcggagtgcctgctggagggagccggtgtgtccaggacacccttgcggagtgtctgctggagggagccagtgtgtcagtgagatggctatgcccctgggctgctgtgtcccaggtttcctcagtctctaaccctttgttctcacaggggatggactcttgcttcttttcccaactccaccaagagggaccgtcccaggacgtccttccccgggcatctggccctacagctgcctgaggtctccatcaccgttggcgccatcagtctgctgtgcagccagctgttggtttggagagcctgaagaactgcagttcacgtctcatctaaaggagctgaaatgatattgcagctttttcttttggttgcgtgcagtgagaatctgggagctgaacctgttatctgcatggtcttcagaaatcaggcaaactcggaaaatgccaacgccaaaaatgctgatgggtgacaaagtgtcacaggtgtgatgcattacaaatctcaggacttttgttcactggatttgacaggtcaagcttcacaggaaaatgatgaagtcccaaaagaccagaaatatatttcagaagatgccagttactactttaaatgtcaaaccaacatttcagaaataactttcaatgattatttcctgccaagaaggtgaacgctggagaccttaatggtggaagatggagggcgtctttccttctgttaagctgacaacttggcttccatcttgtgaggacctcaccctacctggtggcagaggacgtctgacgccctcaatcattgccattacacttcccagcctggtggtcagtctcctggggtctgtgtgttaacaaaccatcgactggacaatcgcagttttccttatgaaggcttactttaaaaaggctctggattttcagaagcgaagtcgctttcatccccgattcagacccatcctagtggaggaaaaatcctaccagaagaagggctgaccataggaacttgccatttccttgaccccatcatatctgaggaaaaaacaacagaaaaggtcaaaacccacgtgtacgcccaacgtcctgattgacgactttgcctgcagcttctgctttcctgaaattcgctgctgcctttagaacccttgtctgcagccagtggggagttcaggacttaggcggagctgccccaccctcctgcttggcaccctgcaaatacatgccctcccttccatcgctgcagacctcagagtgggcgtccggtctcctgtgcgggatgagaatacacaccctcccttccatcgctgcagaccttagagtggatgtccggtctcctgtatgggatgagaatacacgccttcccttccatcgctgcagagtggacgtctggtctcctgtgtgggataatacacgccctcctttcaatcgctgcagacctcagagtggacgtccggtctcctgtgtgggataatacacgccctcctttcaatcgctgcggacctcagagtggangtccggtctcctgtatgggatgagatacactccttcccttccactgctgcagacctcagagtggacgtccggtctcctgtgtgggatgagatacactccttcccttccactgctgcagacctcagagtggacgtccggtctcctttgtgggatgagaatacactccttcccttccatcactgcagacctcagagtggacgtccggtctcctgtgcgggacaagaatacactccttcccttccatcactgcagacctcagagtggacgtccagtctcctgtgcgggatgagatacactccttcccttccatcgctgcagacctcagagtggacgtccagtctctctgtgcgggccaagtgtacacagttttgttccgtcacaacttccacgacaggccagtgtgaggtttttgagctggtgctgactgaaaactgtcagctgcccaaggacctgggagctctgctccccactcctggtgtgcggtcttgcgcctggcctccctgcctaggttacatgcagtggtcatcccggtcgctcccacacccgtgtgggctctgggatcccctcttccagccagcccaggggacatctggctgtctcaggacccagccatctgtaaaaattaggcaggtcccttcagtatgctcctggtcaacaaagaaaaacttcaattttgagaatggcatctgtattccgaagtgttctctcagatgtttgagttccactaagtaggggaagaagatgctgcatacaggatggaatatccaggggaagacgtctaaggagagatgcccagctgggagtcctatgcaaggggaagaagatgctgcatacaggatgggatatccaggggaagatttctaagaagagatgcccagctgggagtcctatgcaaggggaagaagatgctgcatacaggatgggatatccaggggaagatttctaaggagagacacccggctggaagtcaagatatgtcagttgtttccattataataaaaccactcatgttagatgagctgaactttcccttttccccagttcttacgatcaaaaagtggctgtcctaaatttcatcactcaatatccttgctagagtcttcctttgtcagccaggctggagtgcaatgtgcaatggcacaatcttggctcactgcaacctctgtctcctgggctcaagcaattcttctgcctcagcctcctgagtagctgggattacaggtatgcaccaccatgcccaactaatttttgtatttcagtagagacgaggtttcaccatgttggccaggctggtctcgatctcctgacctcaggtaatctgcccaccttggcctctcaaagtgctgggattacagacatgagccatcatgcctggacataagtgagttttatattgtattataagactatgatacagtaaaaccatgaaatccaaatttataatatcacactacataatacaactgtaacctcaccgccctatcctgggatgtgtgtcatttttatagccaattatggcccccagctttagttttcttttgcttattggagagtgtaattctcccttattctttttgctttctacagtcttgtgtacatcagttatctgtttttgtccttttgccagtgttcaaagtgttatttttcgtatttacttaagctcctgcagggagattagaatttcttcccctaagaagaaataagtaatagcggagacctgctgggcactggtggcgccaggcttggctctggggctgcccatccatcctcacagcatggcgactggagggtcttgccctgaggtcccgtgtgcggagcagggcttggcattcactcctaggcactgctgactcagtctgtcctggtggtgctgggaggccgaaacccgtcatgcatgtaaaccgcngggccccgtctggcatggtgcacctgtgctgggagtgcctatagagtaggaaaagtattcctggacctttaaaaaacttaggccaaaaaagtgttttggttgaatctttggccaaattggaactgcaaactctgtattatctccccttttgtgaaattctatggaaaattcgagcaaataaatatgcatttcccagtg

SEQ ID NO: 343909 - DNA, 3603 bp, Homo sapiens
  misc_feature (1499)..(1499): n is a, c, g, or t
  misc_feature (3405)..(3405): n is a, c, g, or t
tcctaagagggcaagcgggtggtactttctgtattttaatattgtgttagaatctgggacatctgattgctgaaatgagatgttagttggtacagggaggggtttccaggacccgcacgcccttgcggagtgcctgctggagggagccggtgtgtccaggacacccttgcggagtgtctgctggagggagccagtgtgtcagtgagatggctatgcccctgggctgctgtgtcccaggtttcctcagtctctaaccctttgttctcacaggggatggactcttgcttcttttcccaactccaccaagagggaccgtcccaggacgtccttccccgggcatctggccctacagctgcctgaggtctccatcaccgttggcgccatcagtctgctgtgcagccagctgttggtttggagagcctgaagaactgcagttcacgtctcatctaaaggagctgaaatgatattgcagctttttcttttggttgcgtgcagtgagaatctgggagctgaacctgttatctgcatggtcttcagaaatcaggaaaatgatgaagtcccaaaagaccagaaatatatttcagaagatgccagttactactttaaatgtcaaaccaacatttcagaaataactttcaatgattatttcctgccaagaaggtgaacgctggagaccttaatggtggaagatggagggcgtctttccttctgttaagctgacaacttggcttccatcttgtgaggacctcaccctacctggtggcagaggacgtctgacgccctcaatcattgccattacacttcccagcctggtggtcagtctcctggggtctgtgtgttaacaaaccatcgactggacaatcgcagttttccttatgaaggcttactttaaaaaggctctggattttcagaagcgaagtcgctttcatccccgattcagacccatcctagtggaggaaaaatcctaccagaagaagggctgaccataggaacttgccatttccttgaccccatcatatctgaggaaaaaacaacagaaaaggtcaaaacccacgtgtacgcccaacgtcctgattgacgactttgcctgcagcttctgctttcctgaaattcgctgctgcctttagaacccttgtctgcagccagtggggagttcaggacttaggcggagctgccccaccctcctgcttggcaccctgcaaatacatgccctcccttccatcgctgcagacctcagagtgggcgtccggtctcctgtgcgggatgagaatacacaccctcccttccatcgctgcagaccttagagtggatgtccggtctcctgtatgggatgagaatacacgccttcccttccatcgctgcagagtggacgtctggtctcctgtgtgggataatacacgccctcctttcaatcgctgcagacctcagagtggacgtccggtctcctgtgtgggataatacacgccctcctttcaatcgctgcggacctcagagtggangtccggtctcctgtatgggatgagatacactccttcccttccactgctgcagacctcagagtggacgtccggtctcctgtgtgggatgagatacactccttcccttccactgctgcagacctcagagtggacgtccggtctcctttgtgggatgagaatacactccttcccttccatcactgcagacctcagagtggacgtccggtctcctgtgcgggacaagaatacactccttcccttccatcactgcagacctcagagtggacgtccagtctcctgtgcgggatgagatacactccttcccttccatcgctgcagacctcagagtggacgtccagtctctctgtgcgggccaagtgtacacagttttgttccgtcacaacttccacgacaggccagtgtgaggtttttgagctggtgctgactgaaaactgtcagctgcccaaggacctgggagctctgctccccactcctggtgtgcggtcttgcgcctggcctccctgcctaggttacatgcagtggtcatcccggtcgctcccacacccgtgtgggctctgggatcccctcttccagccagcccaggggacatctggctgtctcaggacccagccatctgtaaaaattaggcaggtcccttcagtatgctcctggtcaacaaagaaaaacttcaattttgagaatggcatctgtattccgaagtgttctctcagatgtttgagttccactaagtaggggaagaagatgctgcatacaggatggaatatccaggggaagacgtctaaggagagatgcccagctgggagtcctatgcaaggggaagaagatgctgcatacaggatgggatatccaggggaagatttctaagaagagatgcccagctgggagtcctatgcaaggggaagaagatgctgcatacaggatgggatatccaggggaagatttctaaggagagacacccggctggaagtcaagatatgtcagttgtttccattataataaaaccactcatgttagatgagctgaactttcccttttccccagttcttacgatcaaaaagtggctgtcctaaatttcatcactcaatatccttgctagagtcttcctttgtcagccaggctggagtgcaatgtgcaatggcacaatcttggctcactgcaacctctgtctcctgggctcaagcaattcttctgcctcagcctcctgagtagctgggattacaggtatgcaccaccatgcccaactaatttttgtatttcagtagagacgaggtttcaccatgttggccaggctggtctcgatctcctgacctcaggtaatctgcccaccttggcctctcaaagtgctgggattacagacatgagccatcatgcctggacataagtgagttttatattgtattataagactatgatacagtaaaaccatgaaatccaaatttataatatcacactacataatacaactgtaacctcaccgccctatcctgggatgtgtgtcatttttatagccaattatggcccccagctttagttttcttttgcttattggagagtgtaattctcccttattctttttgctttctacagtcttgtgtacatcagttatctgtttttgtccttttgccagtgttcaaagtgttatttttcgtatttacttaagctcctgcagggagattagaatttcttcccctaagaagaaataagtaatagcggagacctgctgggcactggtggcgccaggcttggctctggggctgcccatccatcctcacagcatggcgactggagggtcttgccctgaggtcccgtgtgcggagcagggcttggcattcactcctaggcactgctgactcagtctgtcctggtggtgctgggaggccgaaacccgtcatgcatgtaaaccgcngggccccgtctggcatggtgcacctgtgctgggagtgcctatagagtaggaaaagtattcctggacctttaaaaaacttaggccaaaaaagtgttttggttgaatctttggccaaattggaactgcaaactctgtattatctccccttttgtgaaattctatggaaaattcgagcaaataaatatgcatttcccagtg

SEQ ID NO: 343910 - DNA, 235 bp, Homo sapiens
agaattgaaatgaaatagtaagaagttctgtgtgactgaagcacaggatatgtgtatgtttgtgtgtttgggggaaggagggagaaaaaagtagaaggaaatgaaatggtcttatatggaggtggaagaggctgtcatctccagccatgatttgaggggtacatagaaaattatgcttcctcaaaatatctatctccacacacttgcaaattattgaaatttcatcctgtcgacg

SEQ ID NO: 343911 - DNA, 191 bp, Homo sapiens
catacgttaatactggtttctactgaaacagtctgatttatattgtatcttatctctctgagctagacttggtaaacggcattagctgcatggtaaataatatgagattagacagaaaataggaagaaatttacatctgcaacatacaaaactctagttttagtctaatccctgaggatttggacctcaag

SEQ ID NO: 343912 - DNA, 834 bp, Homo sapiens
cggcggcctatacattgtctgatgacagttggtgggctgatttgaattattttctgtcttcattaccctttcttgctgcggttgattctggtgtaatggggatatcatcagaccaagtcaggcttttgcccccacccaagaatgagaggaagttttgttatgatgtttctagctgtcgttcatccttccctgagacaatgaacaagtggaacaccttttaccagtatttgcagtcaccttttagtaagtttgatgatctgttgaagtacttatgggctgcacacacttcaaccttggcagataatatcaaaagttttgaagacagatatgattattattctaaagcagaagcgcattttgagagaagttgggtactggctgtggatcatttagctgcagtcctctttcctacaaccttgattagatcatataagttccagaagggcatgccaccacgaattcttcttaatactgatgtagcccctttcatcagtgactttactgcttttcagaatgtagtcctggttcttctaaatatgcttgacaatgtggataaatctataggttatctttgtacagaaaaatctaatgtatatagagatcattcggaatctagctctagaagttatggaaataactcctgaaacatttaacttcaaacttcaggaaatgattaatgaattaaaaatgaaaaactcgaactgacaatcagtaatttcaaaaaattaatgtcatcatgaccatgtagtttattctttctgatatttttgatttatgcttatttgttaagatcttgtacatgtattaaaaacttaaattaaatgcattcaagtt

SEQ ID NO: 343913 - DNA, 567 bp, Homo sapiens
ttctgagtagagaaatgatccgtaatataggcctcgcccgatgtgtaggaagaggcagatatgattattattctaaagcagaagcgcattttgagagaagttgggtactggctgtggatcatttagctgcagtcctctttcctacaaccttgattagatcatataagttccagaagggcatgccaccacgaattcttcttaatactgatgtagcccctttcatcagtgactttactgcttttcagaatgtagtcctggttcttctaaatatgcttgacaatgtggataaatctataggttatctttgtacagaaaaatctaatgtatatagagatcattcggaatctagctctagaagttatggaaataactcctgaaacatttaacttcaaacttcaggaaatgattaatgaattaaaaatgaaaaactcgaactgacaatcagtaatttcaaaaaattaatgtcatcatgaccatgtagtttattctttctgatatttttgatttatgcttatttgttaagatcttgtacatgtattaaaaacttaaattaaatgcattcaagtt

SEQ ID NO: 343914 - DNA, 1852 bp, Homo sapiens
gcacagtgacagcttcctttctcggaaacgcggcgcggccggctgccggaaaacagggcagacctgtatgattggtttattcctggggttgtcatatcatggctgataatgacacagacagaaaccagactgagaagctcctaaaaagagtacgagaactggagcaagaggtgcaaagacttaaaaaggaacaggccaaaaataaggaggactcaaacattagagaaaattcatcaggagctggaaaaactaagcgtgcatttgatttcagtgctcatggccgaagacacgtagccctaagaatagcctatatgggctggggataccagggctttgctagtcaggaaaacacaaataataccattgaagagaaactgtttgaagctctaaccaagactcgactagtagaaagcagacagacatccaactatcaccgatgtgggagaacagataaaggagttagtgcctttggacaggtgatctcacttgaccttcgctctcagtttccaaggggcagggattccgaggactttaatgtaaaagaggaggctaatgctgctgctgaagagatccgttatacccacattctcaatcgggtactccctccagacatccgtatattggcctgggcccctgtagaaccaagcttcagtgctaggttcagctgccttgagcggacttaccgctattttttccctcgtgctgatttagatattgtaaccatggattatgcagctcagaagtatgttggcacccatgatttcaggaacttgtgtaaaatggatgtagccaacggtgtgattaattttcagaggactattctatctgctcaagtacagctagtgggccagagcccaggtgaggggagatggcaagaacctttccagttatgtcagtttgaagtgactggccaggcattcctttatcatcaagtccgatgtatgatggctatcctctttctgattggccaaggaatggagaagccagagattattgatgagctgctgaatatagagaaaaatccccaaaagcctcaatatagtatggctgtagaatttcctctagtcttatatgactgtaagtttgaaaatgtcaagtggatctatgaccaggaggctcaggagttcaatattacccacctacaacaactgtgggctaatcatgctgtcaaaactcacatgttgtatagtatgctacaaggactggacactgttccagtaccctgtggaataggaccaaagatggatggaatgacagaatggggaaatgttaagccctctgtcataaagcagaccagtgcctttgtagaaggagtgaagatgcgcacatataagcccctcatggaccgtcctaaatgccaaggactggaatcccggatccagcattttgtacgtaggggacgaattgagcacccacatttattccatgaggaagaaacaaaagccaaaagggactgtaatgacacactagaggaagacaatactaatttggagacaccaacgaagagggtctgtgttgacacagaaattaaaagcatcatttaaccatagacaatttgccaggatctaggaaccacctaatggtaggtggacagaaaaggaaaaaaaaaaaaatttacttgcaagtactaggaattcagatgatcagctcttaaaaaaaaaaaaaaagcaaaaagactaaagccctattaaggaagttattgctttaataagaaatttcaaatattctcttatcccggtccaaaaggattaagcgattaaagaacgtaaaatggagatgtatttacatacacctggaaacctgtgccttgtattcaaattcattaaagcctaatcctgcaagtatctgattt

SEQ ID NO: 343915 - DNA, 1214 bp, Homo sapiens
gcacagtgacagcttcctttctcggaaacgcggcgcggccggctgccggaaaacagggcagacctgtatgattggtttattcctggggttgtcatatcatggctgataatgacacagacagaaaccagactgagaagctcctaaaaagagtacgagaactggagcaagaggtgcaaagacttaaaaaggaacaggccaaaaataaggaggactcaaacattagagaaaattcatcaggagctggaaaaactaagcgtgcatttgatttcagtgctcatggccgaagacacgtagccctaagaatagcctatatgggctggggataccagggctttgctagtcaggaaaacacaaataataccattgaagagaaactgtttgaagctctaaccaagactcgactagtagaaagcagacagacatccaactatcaccgatgtgggagaacagataaaggagttagtgcctttggacaggtgatctcacttgaccttcgctctcagtttccaaggggcagggattccgaggactttaatgtaaaagaggaggctaatgctgctgctgaagagatccgttatacccacattctcaatcgggtactccctccagacatccgtatattggcctgggcccctgtagaaccaagcttcagtgctaggttcagctgccttgagcggacttaccgctattttttccctcgtgctgatttagatattgtaaccatggattatgcagctcagaagtatgttggcacccatgatttcaggaacttgtgtaaaatggatgtagccaacggtgtgattaattttcagaggactattctatctgctcaagtacagctagtgggccagagcccaggtgaggggagatggcaagaacctttccagttatgtcagtttgaagtgactggccaggcattcctttatcatcaagtccgatgtatgatggctatcctctttctgattggccaaggaatggagaagccagagattattgatgagctgctgaatatagagaaaaatccccaaaagcctcaatataggtgagttaaaaataaaaaataaatggcacatgcctgtagtcccagctactcgggacgcttgaggcacaagaattgcttgaagccaggaggcggaggttgcactgagctgagattggaccactgcattccagcatgggtgacagagggagactgtcttaaaaaaaaaaaaaaa

SEQ ID NO: 343916 - DNA, 873 bp, Homo sapiens
tttttaaagaactgttagatggatgttatgtattctcaaactttcttttctctttttctctagtatggctgtagaatttcctctagtcttatatgactgtaagtttgaaaatgtcaagtggatctatgaccaggaggctcaggagttcaatattacccacctacaacaactgtgggctaatcatgctgtcaaaactcacatgttgtatagtatgctacaaggactggacactgttccagtaccctgtggaataggaccaaagatggatggaatgacagaatggggaaatgttaagccctctgtcataaagcagaccagtgcctttgtagaaggagtgaagatgcgcacatataagcccctcatggaccgtcctaaatgccaaggactggaatcccggatccagcattttgtacgtaggggacgaattgagcacccacatttattccatgaggaagaaacaaaagccaaaagggactgtaatgacacactagaggaagacaatactaatttggagacaccaacgaagagggtctgtgttgacacagaaattaaaagcatcatttaaccatagacaatttgccaggatctaggaaccacctaatggtaggtggacagaaaaggaaaaaaaaaaaaatttacttgcaagtactaggaattcagatgatcagctcttaaaaaaaaaaaaaaagcaaaaagactaaagccctattaaggaagttattgctttaataagaaatttcaaatattctcttatcccggtccaaaaggattaagcgattaaagaacgtaaaatggagatgtatttacatacacctggaaacctgtgccttgtattcaaattcattaaagcctaatcctgcaagtatctgattt

SEQ ID NO: 343917 - DNA, 1428 bp, Homo sapiens
gcacagtgacagcttcctttctcggaaacgcggcgcggccggctgccggaaagtgatctcacttgaccttcgctctcagtttccaaggggcagggattccgaggactttaatgtaaaagaggaggctaatgctgctgctgaagagatccgttatacccacattctcaatcgggtactccctccagacatccgtatattggcctgggcccctgtagaaccaagcttcagtgctaggttcagctgccttgagcggacttaccgctattttttccctcgtgctgatttagatattgtaaccatggattatgcagctcagaagtatgttggcacccatgatttcaggaacttgtgtaaaatggatgtagccaacggtgtgattaattttcagaggactattctatctgctcaagtacagctagtgggccagagcccaggtgaggggagatggcaagaacctttccagttatgtcagtttgaagtgactggccaggcattcctttatcatcaagtccgatgtatgatggctatcctctttctgattggccaaggaatggagaagccagagattattgatgagctgctgaatatagagaaaaatccccaaaagcctcaatatagtatggctgtagaatttcctctagtcttatatgactgtaagtttgaaaatgtcaagtggatctatgaccaggaggctcaggagttcaatattacccacctacaacaactgtgggctaatcatgctgtcaaaactcacatgttgtatagtatgctacaaggactggacactgttccagtaccctgtggaataggaccaaagatggatggaatgacagaatggggaaatgttaagccctctgtcataaagcagaccagtgcctttgtagaaggagtgaagatgcgcacatataagcccctcatggaccgtcctaaatgccaaggactggaatcccggatccagcattttgtacgtaggggacgaattgagcacccacatttattccatgaggaagaaacaaaagccaaaagggactgtaatgacacactagaggaagacaatactaatttggagacaccaacgaagagggtctgtgttgacacagaaattaaaagcatcatttaaccatagacaatttgccaggatctaggaaccacctaatggtaggtggacagaaaaggaaaaaaaaaaaaatttacttgcaagtactaggaattcagatgatcagctcttaaaaaaaaaaaaaaagcaaaaagactaaagccctattaaggaagttattgctttaataagaaatttcaaatattctcttatcccggtccaaaaggattaagcgattaaagaacgtaaaatggagatgtatttacatacacctggaaacctgtgccttgtattcaaattcattaaagcctaatcctgcaagtatctgattt

SEQ ID NO: 343918 - DNA, 452 bp, Homo sapiens
ggttccataaattatcaattatttcaaatatatttattttggcacagttttagtgcaatcaaaatgtggacagtcacaagaagatttttgattgtaagtgagtaaggaatcaattaaaacagtgttctagaagaactgtagtcttgaattttagactcttagaccacaaacgaacctggaaaagtcacacataaactgtacaaaattagataatatgggcttcaaacaaaaacaacagcaagctctctttcggtatgaaaactctacttttttttttttttttttttttttaaagagccagtccttgttttcttgtctctaaaatgtggatggttatactgtatctgcttgccaaattcatagaattcttgtgaaaattaaatggattaatttatgctagagaaatctataaattataaatctctgtacaataatttttcaaaatatggtat

SEQ ID NO: 343919 - DNA, 1089 bp, Homo sapiens
ctgtctgtgtgcccctgggaatgatcaggaaagactgaaagcgatgatgccagacagagggcagctcctggagtgatgtcaggaagtccgtgtggtggtgctctgtcgctgcataacaaactacccactacttagaggtttaaaaattaaaagcaagttagctcacagtttcagtcgatcaggaatccagcttagcagggtgattctgtccaagttcctcctgagggtacagtcatctaaaagcttgtccggggctagaagaaccctcttccaagcttccacacatggcttttggcaggcggccattgttccttgccacatggcctctccacagggctgcttgaatgtcctcacagcatggctgacttcccccagagcaagccatccaagagagcaagagactaagatgggaaccacagtgtcttttgtgacctagtattagaagttgcatgtcatcccttactctgatttgttagaagggagtcactaagtacaaagtagggtggccagacatccaaataaagataaacaaaggcttattagtataggtgtattccaaatattgcatagggaattcttacactaaataatgactttatctgaaactcaaagttaatgtatgacctgtatttttatttgttagatttggcaacttcagaaggaatttgtggacatacttttaaactacggctagccaaagggaatgggatgtagtgcatatgtagagctcaggcctacagaaacacggcagatcatagggagagggctggcggagtacttggcaaatgtagataggtaggcgggtgggtaggcagaggcagtgaggggagcaggtggacatgctcttctgattgcttctcttttctcaccggagtaagcagcaaggttatgggcaaggtaaccttctcccgccccgccatacaccttgcacagagcttacccttgactcagaccctccatgctgggggaattacctccctgtgaccatcctaggaagacacctcttggctcttgcagagtcagaaaagcacaggacatggagttgagaaacccggtttcttctttttcttctttttcttttttttgaga

SEQ ID NO: 343920 - DNA, 361 bp, Homo sapiens
atcacatttcttaaaaagtgaattgtgcttttcgtattgtgtctaagaattctttgcccaaccaaaggtaaggattttctcctgtgtttcttcttgaaatggtacagtaataattattacatttaggcctatgatttatttagaatttttttttgtgtagtatgaggtaagggctgaagttcaagttttttgtttgtttgtagcatgtggatacacaattattctagtgctaattgttgtgaaggctatctttttttgccttgattcgttttgatcactttgtaaaaaaaaaaaaatcaattgactgtaaatataagaattgattcctggattctcatttatgttcagttgagtcaactga

SEQ ID NO: 343921 - DNA, 896 bp, Homo sapiens
gcctgaggaggggtagggggcggtggccccgggttctagcccgcctgtcctcggcccccacttctggaatgagcctgcccgccccctgactctcaggccacagctccggccacagctctggctcctgctccgcggcggatcccacaaacccggcagccacggcggtggcggtggcggtggcggtggcggtggcggcggcggcggcggcggcagcggcaggcggcatcccagggtgataggctgaagcaatcgagggccgagagcccggccgcgtgtgcactcgagtaacgaagccggggagggactgcgccgcaggcaggaaaagtcggacaccgaattattcatccggcctgtcccgcctactttccaagtaccctcccagggatagccgggtattgagcggtccgggtctctgctgctcaaagatcgaagaagctgctttatcttacagtcacccaagggggagcgccttcttccttcccagagtggagtggcagtgggtccgggattctgggatatgcacagggtctgcgccctgcgccctgtccgcgctgaagctgaacttgtcattggtttgcaacagcatggtgaagaagtgtggtgtggatggacggacgggcctctcaggcacatgaaatactcaaagcccagtattaaccaaacatgtttctctgttttgtctttgatctttgtgcagtgtgttggcttttttcctttaatgatgtcacttgtattttatttttggtttatttgtagactgtctccctccttggccatggctttacttttatgtccacccaaggagagtttcaccagtttaggtttaagaaattactgacaagttaacaataataatttcaaaattgaacagtaataacttaaaccgtgccttggac

SEQ ID NO: 343922 - DNA, 923 bp, Homo sapiens
gcctgaggaggggtagggggcggtggccccgggttctagcccgcctgtcctcggcccccacttctggaatgagcctgcccgccccctgactctcaggccacagctccggccacagctctggctcctgctccgcggcggatcccacaaacccggcagccacggcggtggcggtggcggtggcggtggcggtggcggcggcggcggcggcggcagcggcaggcggcatcccagggtgataggctgaagcaatcgagggccgagagcccggccgcgtgtgcactcgagtaacgaagccggggagggactgcgccgcaggcaggaaaagtcggacaccgaattattcatccggcctgtcccgcctactttccaagtaccctcccagggatagccgggtattgagcggtccgggtctctgctgctcaaagtaaagaccgtttgagaaggcggggaggatcgaagaagctgctttatcttacagtcacccaagggggagcgccttcttccttcccagagtggagtggcagtgggtccgggattctgggatatgcacagggtctgcgccctgcgccctgtccgcgctgaagctgaacttgtcattggtttgcaacagcatggtgaagaagtgtggtgtggatggacggacgggcctctcaggcacatgaaatactcaaagcccagtattaaccaaacatgtttctctgttttgtctttgatctttgtgcagtgtgttggcttttttcctttaatgatgtcacttgtattttatttttggtttatttgtagactgtctccctccttggccatggctttacttttatgtccacccaaggagagtttcaccagtttaggtttaagaaattactgacaagttaacaataataatttcaaaattgaacagtaataacttaaaccgtgccttggac

SEQ ID NO: 343923 - DNA, 314 bp, Homo sapiens
aaatttgtggatgggtttggtggattggtggccagggatgccatcctgcaatgtgagagacagcgaataattatcttgcatcccacaagactttcagatgccccagaaattcatgtaggaggaaaatataattagcccagaacctaactctataatatatattcactttgccaggagttaaatttcttttaattcatttttttcttgcctgcctgcctccctccctccctccctccctccctctctccctctctctttctctctgttttctttctttttccttcctccctccctgcctccctcccttacttcag

SEQ ID NO: 343924 - DNA, 559 bp, Homo sapiens
attctgtaactgggtccttgactcccttgctctgactgttcccaccctgtggaatatactttcattttcagtaaatctctgcttttgttgttttattctttcctcgctttgtttgtgcttttgtcctattctttgttcaaagcgccaagaacctgggcgcctccactggtaacatctcctatcttggatctccaagtttcctggattccattttgtcatctttttagctcacttccttgttgtagaggacatcttttctgagagaggatacaaggggagataaatgtgtattagaccttccaggcctgaaatgtctatcctacccttatacttattgatagatcttattggatacagaattggaaaattgcttgcagaatttcagaagtattgatcagttgtattctaggttccagtattgctttggagaagcagtagcccttgttatttttgtgcttttccttcatactctttttttttttaaagttatttatttatttattttgtagagatggagtctccctctgtactccaggctggagtgcagtggcatgatctc

SEQ ID NO: 343925 - DNA, 979 bp, Homo sapiens
ctttaaatggcagaacatcaggtttccatttccaaaattatttttcttcatgctctgactgaaatagtgactggtgttggagaaacgggtggaagatagcgtaataaaccaaattgttctttctagtggggaaagcatgaatcacccaaaactaataatcacggaatttacttacatggtatggaagaataagcaaccatagaagaaatcagaatagttgtcacagaactaatttacaagcattagtgctgtttcccaggccaggttctatcttgttctcaaggaatagttacatcttcagtgtaaattatgggtaccattgagagaagttttactttctactttatgaaaatgatgatgatgacaataataccgcaacatgagtactgctaatggaaacactttatgcccaggcacagtggctcacgcctgtaatcccagtactttgggaggccgaggtgtgcagatagcttgaggtcaggagttcaagaccagcctggcctacgtggtgaaaccccgtctcttattaaaaatataaaaatcagccgggtgtggtggtacacgcctgtaattccagctactcgggaggctgagacaggagaatcgcctgaacctgggaagcggagattgcagtgagctgagatcatgccaccgcacttcaatctgtgtgacagagtgagaccctgtctcaaacaaaacaaagcaaaacaaaacgcttcagacagaattactgtcaagcacgtcacgatgcaccttctgtgggttatcttactacattttacctgtctactgatgccccagcgtggccacagcctgaactgcagcaccttcctgcagataccccttttttagtgaacaagtaaatgctgcttctagtccccttggtactaggtctgtgcagagcacagagaaagatgaatccagccagagactgccccagagtaactcccagaggtggaatgagtgagataatgctggg

SEQ ID NO: 343926 - DNA, 276 bp, Homo sapiens
tcctatgaaagagttccacaatatactatttaggcaggcatgcaactcggctccatagagttatcaggaatccaggctgatggtggctcttctgcctttgataagtagcttccgaggtcactccagtcatcaccatttcatctggtaagaaagtaggcaaaggtgtgaaggagtgggcaggagtttcacaggtcagtcatgtaagtggcacacacacttcctcttatattcagctggtcacatggccacactggctgcaaaggagaatgggaaatg

SEQ ID NO: 343927 - DNA, 705 bp, Homo sapiens
tcttcctcaccctactttacactatttttgtagtttccatctatttattttgtatatgtagtatcatatttattgttaaagttttaaaaaaatttgtcttttaacttttgtacaatgattaaaagtaatttaccattatattattctatatacagaacctatacatttgtctttactaatgaatattagtaagaaatacgatactcatttaaaaagtaaatatatagaaaatattttatgctaccaccttgccgtatatcatcctttcattttaacatgaaaaaatccctttagtatttcttgtaaggcatgtctagtgataatcaactttcttcacttttgtttgtctggcaaatactttttctctccttcattttcaaaagacagttttgcctgatatagtattattgattagcagttttacgttttctgtcagcacttcaaatacataatctattcctttctagtgtgaaatattctttctgagaaatctgttgatagtcttacagagattacttggtgcatgacaaatcatttctttcttgctgctttaaaattcatcttttgacttttgacaatttgattataatgtatctttatgtgcatttatttgggttcatttgattttgcaatttttaggtctagatgtctattttcttctccagatttgggaagttttcagtcattatttatttaaattatctg

SEQ ID NO: 343928 - DNA, 463 bp, Homo sapiens
ggatcccaggtgtactgaggagggtgagctctctgacacgggttagcgtcattgggatatttgtacaaacgcaacatagtaattgggtttcaccatgtacaagagaaaagcactaaggtttttaaaaacccagctcatttggcctgtgaaatcttaccaggatgcccctcctttttccttcccacctgcccccttccttctcattactgctgtccttgtgcagcatccccccagtcacgtgctaagcctacctgaagatgctgaccattttcaataatgcaacgttagggtcagaggagagcaaggatcatcagctagtaccctggaggcaaattcttaggacagagattttctcagcctgattctagaactatgggcaagccagggattccccccacaaatcaacagggctgctctgttatttcatgtgagaccttactccccttctagtcagggagctcct

SEQ ID NO: 343929 - DNA, 585 bp, Homo sapiens
agacggaatcttgctgtgtcgcccaggctgaagtgcagtggcacgatttcggcccactgcaacctccacctccgggttcaagcgattctcctgcctcggcttcctgagtagctgggattgggattacaggtgaggggcactacgcccggctaagttttgtattttcagtagagacggagtttcaccatgttggtcaggctggtctcaagctcctgaccttgtgatccgcctgactcagcctcccaaagtgaaggcaaagatatttaaaacgacatacctgctaagtggtagaaccaggtttgtaacccagactgtctggccccaaaccagagttcctcaacactgcagtgacaaatctcagctgagaagctgtattccagcacagcttcacgtagtcctcttgaaatacacatgtccattgcatggtttacacacaagtctatttgcttgtctgcccacacactggactataatctccttgaatgtaggagactcatttctcaatgtctgggatatagatggcattcatgcagatggtaatgagggcagttgtagctatgcgtatttcttccttgcttgttatgt

SEQ ID NO: 343930 - DNA, 503 bp, Homo sapiens
tcactcgaggtcaggagttcgagaccagcctgggccacagggtgaaaccctctctctactgaaaataccaaaatgagccaggcactgtggcaggcgcccgaatcccggccactcgggaggctgaggcaggaggcgtgagccattgcgcctcttacatttttgtttctcattttctcctgaacctttttttctgttgccatcactgtactctctccagaatcaccggtgacttcagagttgctaaatccaggagacagtttcagtcctctctgcctctgagctgtttcctctgcctgcaattctttttcttcccacctaagcctgtttgtttcttgctcacttagtaaagtcactttcccagggaaaatgtttccgcaccctttgcttttcaactgtggttgaatacttttataattatttgttgaatttctctagggctgcctggtttgtgggggctaggattttctttacttatttatttttggaggcagagtcttgctctg

SEQ ID NO: 343931 - DNA, 558 bp, Homo sapiens
tcactcgaggtcaggagttcgagaccagcctgggccacagggtgaaaccctctctctactgaaaataccaaaatgagccaggcactgtggcaggcgcccgaatcccggccactcgggaggctgaggcaggaggcgtgagccattgcgcctcttacatttttgtttctcattttctcctgaacctttttttctgttgccatcactgtactctctccagaatcaccggtgacttcagagttgctaaatccaggagacagtttcagtcctctctgcctctgagctgtttcctctgcctgcaattctttttcttcccacctaagcctgtttgtttcttgctcacttagtaaagtcactttcccagggaaaatgtttccggtcattctccgggcaccctaggctacatcaggtaacctgttagaacatttcaaagcaccctttgcttttcaactgtggttgaatacttttataattatttgttgaatttctctagggctgcctggtttgtgggggctaggattttctttacttatttatttttggaggcagagtcttgctctg

SEQ ID NO: 343932 - DNA, 169 bp, Homo sapiens
cctgtttcaggtatgtctttaacagcagtgtgaaaatggactaatacacctagttacccagaacttgggtaaaccttggaagtatctctggcttctctataacaatgtttaatgttcaatcagttgataaagtctcaatcagataaatcactaacacctctgacatagt

SEQ ID NO: 343933 - DNA, 366 bp, Homo sapiens
actcaaattacacttttaatcataaaaaatcatcagttttgctaaaaaagtttcactagcccctttttctaaattataatgaaaattacattattctaactttggggtaattgtttaatatttctgctacacagtatcaatcagcataaaggattggagttcctagttctcttctttggtactgattatataatagtcaagttctttcgaattataggattttagttagtattaaatatactaaatagcatgtgtccttcacattctttcaataaactgctgcgcacacaaataaatattatggtaacggcaaataaacttcatattgaacttagaattggaactttttattaaccattccaactc

SEQ ID NO: 343934 - DNA, 490 bp, Homo sapiens
gtggagtcatggactgttcttcattttcagtatgctgaatgatttttctgatcatggataatcagaaaaacagtaatgctgaagactagctgagagtaggcctggcaggaactgtgtgagctaaaggagaagaggaagacatgagacttggactgtggttaaatgggtccctctcctggctaatacatatggaagcaggcaccttttaaagacatcagctaaagcagattcagttttcagttaagggacatatagcaattatgatgttcggtggaagaaccagattctcttgtcttccctgagacccagaggctgaataaccaggaacttccagagatacttggttctcagaaagaaagaaagctgtccaacatgccattgaggatactggcttaaaagaagtctgttcttaccaggctgaagtagagctcttctcttcctcagacagatgcctcattaggcaaaattaaaaatctaggaaaatagagta

SEQ ID NO: 343935 - DNA, 309 bp, Homo sapiens
catgaaaaataaagaacatccaaaatttaaaaattgaatatacagaagaagtaggatgatttataagttacttcatacactacaaaatgcttcagttctgaattccattaaatagctcatcgttacttcatatactacaaaatgcttcagttctcaattccattaaatagctcactttttgatttcaatttattatttgtatttcaacaatcttttttttttttgggatggagttttgctcttgttgcccaggctggagtgcaatggcgcaatcttggctcactgcaacttccgcctcccgggttcaag

SEQ ID NO: 343936 - DNA, 766 bp, Homo sapiens
tgcacatgaagagaaaatcctgtgtgtgtgtcttcatacttgctggctctagtaccagaagagagggatctggcttcagagcaggactgaaaacttctcaccagtctggggataatagtgttgaggcaaattcattctcttgacttgcaaaaacagatttttctcatcttcctccttctctcaccttttttgcagtagcatttttcctcaaagtacaactcatttttttactaacgcctaactaatcctagtgttattttatcatatttttaccaagaatgttctaaaaatcttggagacgttcctccatgatcttgggaaaaaaagttgccaaatgctgtgctgttttttttgtttgtttttaattttctttcatttacagatttcatgaaacttatattctgtggctttgaccctcaccaatcttggaagattgatctctcaaggacaaacccagtgcctatttctcagtcctttttctacttgacatttgcagaattggcactttttgccactgttatgccttaaatcttgagcttctttcaggatccatgattctgtgctgatctacacttttcctacctctcagcatttctttgattgtcaatgatcagctctgtgatttggggcaagggttaggccagaattatctcattttatcaagttataaaacttgaggtagtgcaactagattatacacttcttgaagacagaaatcttggtttgtttgttgttttatttttgagagaaggtcttgctgtgttgc

SEQ ID NO: 343937 - DNA, 602 bp, Homo sapiens
gaggcagaggctgcagtgagccaagatcatgtcactgcactcccgcctgggcgacagagcaagactgccccaaaacaaaacccaaaaacattttctgacctggagtcatctgaaaccaggtgtcaaaaacctataaaagagaagctaagggatattacaagaatgcgcttcctcctgtcctcctttcccccttcattggttatatctccctcacctccccaaatgttcatgtaacatacacaacccctgccaaaaaattcacccacccaaccaaacagacaatgtaatgagctggtttttgccttcggtggttgaagtggatacatttttattccctgagagtggtgaaggaatcaagctaaaaaagaagagttctattaatgtatcctggttgagtttcatctctttgtgaaaatcacattttgggttcagatgttcattcatctacctaggcatatgcagtgttattttaccgtttcattttgattacaggatggaaaaattcgagtcaccattcttgcacggagcacagaataccggaaaatccttaaccaaaatgaggttagtttttggtatgcatttttaatgccttcatattcaat

SEQ ID NO: 343938 - DNA, 533 bp, Homo sapiens
taaattacccagtccaggtatttctttatagcagtgcaagaatgaactaatacatctatcaaaaatggagcaatttcaaaactataaatgtgatcttaatatgtatttatccaatttaaaaagcaagtgtcagagaaaaacttcatcctctcctgctcctaactgttgatctctgaatccactatgctctcttatgcccctatgcctttgaaattgttattttcccctttgcttgtttagaatctcctccttaaacctgtctggcaagtttctactcattatggaagtcttccctggttttcccaaaaaagatgcatgcaatcttcccctatgcacgtttatatacttacataagtacctctcaaactatatcataactgtctcttatggttagagaacagtaagctctctacaggcaatgactgaacacctcttggcagaactaatattgaactggtacacaccaacagagcctgaagggtcatacttaagtacggaaatacttccgtaacatagtctggtacgtgtcactg

SEQ ID NO: 343939 - DNA, 435 bp, Homo sapiens
tgagtaagatatgagaaagagcagagaagaaaaagggacgttccaggcagtggaaatgagcaaaggtataaaagggataatttcttatagtagtgattctcatctttttgtttccctagatttgcctctaaccaagtgatgacacagagaatgccctcaatttctaaagtcccttgcctacccataattttgaatgttaccaaaacccacagatttaatgtgctgatcagttaatcaaaattcaatggagacagtctatttctgcatatgtcttcagataacttttgtgaacataaaaatccaacacatcgagccaggcaatgactgaacacctcttggcagaactaatattgaactggtacacaccaacagagcctgaagggtcatacttaagtacggaaatacttccgtaacatagtctggtacgtgtcactg

SEQ ID NO: 343940 - DNA, 238 bp, Homo sapiens
ttttgtgttaaaataacacttttttacttctcaactcagacaagcaaaattttgtcagcccatggacaagttgcttaaggcatctattcggtatttacataactgctgtctcattatctttatgacccgtggggctagtagcttttatagaattgaagatgacattttgtgacaataagaggctagaactatgatccttttgtacagttaaattctgtagtcttaaccattggtccag

SEQ ID NO: 343941 - DNA, 485 bp, Homo sapiens
gtaactccttttcccactctgggcctgttttcccatccctaaaacaagagagttgacacaatcaaccattcagtttgtcttggcattaaggttgcatgagtgtgaggatctcagggtcagatgggctctgccttccagtttgctagcgtcccacctcctaatgggaattcacacacatgtgggtatgcctacacacacacacacacacacacacacacacacacacacacacacacagcctcgctcaggtctgaaggtttttctcttgtttggttagactgggtatgcctgtacacacacacacacacacacacacacacacagccttgctcaggtctgaaggtttttctcttgtttggttagactgcttctccctgagcatgccagtgcctgcatctggccagaccatttttaatttgagacacacacatctccgtgctgttgatctccttcctccctggccggtagtctgggtagccctgacc

SEQ ID NO: 343942 - DNA, 444 bp, Homo sapiens
tggttgtgcctgtgcctccaaagcatggatttgatagctccaatattgtaatctaaatttcctggcaatgcccccactgctggatagattgctgttgacagcttttgaccagagggagccattagattttgctggctagcaaacaattacagctttgatatgagctacaaggctctacctctcccctgagtattagaagtctgaaaagaagagctgtctccatgaagatgggccaaatgccctccctcctgtggctgattgtgctacatcatcccaacatgataaaccagaaatctttgagtaccacatcctaattcttatgaaaatccagataccattgataatctttgcagtaagcatgcaaaaatatgtaaactgctcttaccaaagcaatctgaaagcataatttttgtgacaagaataataactgtgtgagaaataaaa

SEQ ID NO: 343943 - DNA, 945 bp, Homo sapiens
gaaatcaacaatgttttagatcaaagctgttccattttcctggatcctagtggggagctaacatggcacagagccacagccaatccaaggacatgtgaatcctagaaaagaggagttcctccaaggccctggaatcagaaacttggattgccaggacctgccctcagtgttcttcactccacacaacacagctgacccagacatcatgtgcaggaggtacctcctgacagcaggcttgacaccagctactgtccagctccccagtaaaccagattccctcattgctcctaatggggtctagactgcaggaggaggaagcaggtgggcaatgtccagatttccatgatgaccctctgaggagatatccgtggctaggttactgcacgactacagcatcacagaggagactccagaactcaaactaccaagagcacccctccatcagctttgtttcctaactcctggcctgcctcctttcttgtggcgccatctcacagccaaatgacaacaagccctctctgtccctcacaaaatgcctgtgataaaaagttccctttgcagccagaccagctgagactggtacatagaaccaagacagctgaccaaaggacttcaaaaagacctcagtcttcatgataatcttatttccatgctaaatgatactccctccagcaccacgacagttgacaattgccatgacaatgactggaagaagccgtaaaaggactaaaagggaggcggtactactgattccaggaggttcaccacccacttctggaaaagacatgaatattcttcccttttcttttaatgtcacctccttcattagagaaatcctgtatcttaagcccctcaccctcacttgttgagaagttgattgtgagccatctcctgcttctcaattccacggccattgaataaagcctgcactgcttgacactcact

SEQ ID NO: 343944 - DNA, 888 bp, Homo sapiens
gaaatcaacaatgttttagatcaaagctgttccattttcctggatcctagtggggagctaacatggcacagagccacagccaatccaaggacatgtggacctgccctcagtgttcttcactccacacaacacagctgacccagacatcatgtgcaggaggtacctcctgacagcaggcttgacaccagctactgtccagctccccagtaaaccagattccctcattgctcctaatggggtctagactgcaggaggaggaagcaggtgggcaatgtccagatttccatgatgaccctctgaggagatatccgtggctaggttactgcacgactacagcatcacagaggagactccagaactcaaactaccaagagcacccctccatcagctttgtttcctaactcctggcctgcctcctttcttgtggcgccatctcacagccaaatgacaacaagccctctctgtccctcacaaaatgcctgtgataaaaagttccctttgcagccagaccagctgagactggtacatagaaccaagacagctgaccaaaggacttcaaaaagacctcagtcttcatgataatcttatttccatgctaaatgatactccctccagcaccacgacagttgacaattgccatgacaatgactggaagaagccgtaaaaggactaaaagggaggcggtactactgattccaggaggttcaccacccacttctggaaaagacatgaatattcttcccttttcttttaatgtcacctccttcattagagaaatcctgtatcttaagcccctcaccctcacttgttgagaagttgattgtgagccatctcctgcttctcaattccacggccattgaataaagcctgcactgcttgacactcact

SEQ ID NO: 343945 - DNA, 724 bp, Homo sapiens
gaaatcaacaatgttttagatcaaagctgttccattttcctggatcctagtggggagctaacatggcacagagccacagccaatccaaggacatgtggtacctcctgacagcaggcttgacaccagctactgtccagctccccagtaaaccagattccctcattgctcctaatggggtctagactgcaggaggaggaagcaggtgggcaatgtccagatttccatgatgaccctctgaggagatatccgtggctaggttactgcacgactacagcatcacagaggagactccagaactcaaactaccaagaatgcctgtgataaaaagttccctttgcagccagaccagctgagactggtacatagaaccaagacagctgaccaaaggacttcaaaaagacctcagtcttcatgataatcttatttccatgctaaatgatactccctccagcaccacgacagttgacaattgccatgacaatgactggaagaagccgtaaaaggactaaaagggaggcggtactactgattccaggaggttcaccacccacttctggaaaagacatgaatattcttcccttttcttttaatgtcacctccttcattagagaaatcctgtatcttaagcccctcaccctcacttgttgagaagttgattgtgagccatctcctgcttctcaattccacggccattgaataaagcctgcactgcttgacactcact

SEQ ID NO: 343946 - DNA, 698 bp, Homo sapiens
ttcccagggccctacaatgaatagtgggtcgggactcacttggtgactgctgggttgtgaggccttgagggggaggggcagacttcacccatctggcagagggacatcggtgctggcagtcaggaaacccttatttccaggcctcagtttcccggaagtgacctgttttcaggagtggcctcatcccagaccatcagccccgctgtggtgaggggtggccccttcctggggctgccctagaagggggaggtccctgcacccaccgcagctgccactcggcagcccttggccttaattaaacgcttcttgcgtactaagtgctgcacccatattatctcccttctaccattcgacgccagggagataatgactgtcctgttttctggaggagtaaacggagggttggagcggttaaggctcgctcagggtgccagcgaaccagtgatttcgaacacagagttctggtgtgttgggccaggacttctctgctttgaccctttaacgaagggggcgggagctgagggccagtgaccgccagtaaccccggcagacgctggcaccgagcgggttaaaggcggacgtccgctagtaaccccaaccccattcagcgccgcggggtgaaactcgagcccccgccgccgtggggaggtggggcgggggccggggccgggccctagcgaggcggcagcgcggccgct

SEQ ID NO: 343947 - DNA, 551 bp, Homo sapiens
aaatcctagtggactcagacagcaaagtgggaactatctggtccacccaggagtatgcctggaagcccaagatcatcttttcaaagacagagtctgtcttccaacctcagcaaaatcaacactcaagactacagcctaatctgttttgtcgctggcaaccccctctcgaaagcgtaaacgctcccagggagccaccaggaacagatgtggacgggcagctcccacccagggcacagctgtcattcactcggctcagaactgggaagccggccgggcacagtggctcacgcctgtaatcccagcactttgggaggccgaggcgggcaggtcacctaaggtcaggagttcaagaccagcctgacgaacatggtgaaacctcatctctactaaaaatacaaaaaattagccaggcatggtggtggacacctgtaatcccagctactcaggaggctaaggcaggagaatcacttgaacccaggaggcagaggttgcagcgagccgagattgcgcctttgcgctccagcctggcaacagagggagactccttctca

SEQ ID NO: 343948 - DNA, 560 bp, Homo sapiens
atgttaacccaaagatggataggaaaacaaaaatatgctacaaggaaaattattatgggctattcaggtgttcttgttactgtatgtgcccctaatattaggattttcttcacagaacattatcattcaaaaaagaagtcattacatatattcaggttcttacaaaggctctcatgttactgactaatctttcaattacagtactttattttgaacatcaaaatggctttcatgaatgtttgcttatgatgcttgaagaagttactggtaaaatcagatttataaagaagaaagatttaacacaaatttagtaatttggtcatgacctcacaacgacaagtgttgggcattattgtaaacaaccctttttaagaacagataaagcagcaccacaagtgtcattgctatggagatcacaacccctgcaggatctatgacaaactgtcctgctatttagcaaattggtacttgtggtaactgtgccatacatgaattttaaaaagtgctatacctcaaacaatctggaagggaagacgatttgctcaggaaagtaaaaaaaa

SEQ ID NO: 343949 - DNA, 281 bp, Homo sapiens
acacaaagtctttcagaaaagaaacagggtgatcttgattatgctttggaaaggttgataaaaacagcttgttctctgagaacaccctccagacataggaagagtggcttgaaataggtgaggtcaactaagagaaaatgatctgggatcagccattcacttcagataatccaaaaagcaatggttaaatgggttggtacaaggacagggttacagtatataagaaaagcattagcacagaaaaaggagtcgtgtaagaaagtcgccaaggtgaaagtcac

SEQ ID NO: 343950 - DNA, 202 bp, Homo sapiens
ttctgcttgccaaaagatggaatttaattagagtattagaatgacaaagtcatgatttttaactagatcactttttcagtagtggggaaggatttaaggggagcaaaattgggatagaggacatcagtttaggcaagagttaagcgtcagaaatgtagtggcagtgggtttggagaagacagagtgaacttaagagctattt

SEQ ID NO: 343951 - DNA, 875 bp, Homo sapiens
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggggaatgtggtcctggggagcaggaacagagcccatcttaatcccggaaggccggagggctggggtacccctctgccagttggtaattgggcgggccctgatggggccagcaggattttataatgggcccatggcgcggagcctccg

SEQ ID NO: 343952 - DNA, 880 bp, Homo sapiens
  misc_feature (716)..(716): n is a, c, g, or t
  misc_feature (718)..(719): n is a, c, g, or t
  misc_feature (723)..(723): n is a, c, g, or t
  misc_feature (725)..(725): n is a, c, g, or t
  misc_feature (740)..(740): n is a, c, g, or t
  misc_feature (746)..(746): n is a, c, g, or t
  misc_feature (754)..(754): n is a, c, g, or t
  misc_feature (817)..(817): n is a, c, g, or t
  misc_feature (828)..(828): n is a, c, g, or t
  misc_feature (847)..(847): n is a, c, g, or t
  misc_feature (858)..(858): n is a, c, g, or t
  misc_feature (880)..(880): n is a, c, g, or t
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccttgggagcaggaccanannccantnttccgagagtccganggctgngcttcccnagaaaaggaagatcaggggtgggcaactggtactgaagtaccaggaagaattctgcaattggntacttgccggncctggtgggaaggaccacnggattctttantgggcatccaggccgtgggttn

SEQ ID NO: 343953 - DNA, 417 bp, Homo sapiens
ctcctaataataacgacaacgatacaatggtaacagtaatagcattccagggaagagcaaccattgaagatgtctgtgccttgattttcccactggaaaatggcacctgcggtaaaccagaagaggaaaaaaaaatctgatcatttcatggaataccctttggagataaatgattcagcaagcagaggtttctggccccaggcgacagctgctttcccttccctgagtgtccctgcctacggacccctccctgagtctctctgtgtccacagggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 343954 - DNA, 1357 bp, Homo sapiens
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 343955 - DNA, 1807 bp, Homo sapiens
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaaaaaaaaaaaaaaaaaaaaaaaaaaaaaaaaaaaaaaaaaaaaaaaaaaaaaaacatgttagaccgactagacccaaaaagcattttaaactggggcaagcttatgcatgacggccgaaaaaaaagtttattgggccatttccccctataatttggactttaaccaatttattgccgggggcttaaaaagggcttaattgggaaaactcccccaatgccgagcttattccatttgaggggcatcctttttacaccggttggcttggaaaaccctgggctctccccaatttaccttctaagcagaaagtcctcttttaacggctaggggaaattgcaagagggcccctcccgttaactttccaaaaaattgccgaacctaaggcaattgggaaccgagggcctaaattttgg

SEQ ID NO: 343956 - DNA, 1486 bp, Homo sapiens
  misc_feature (1430)..(1430): n is a, c, g, or t
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaaacaaaagaaaacaaaaaataaagaagaacttaaacggcagtgggcaaggaacttcctgcttcttctatatggncccttctgggccgggcccctaatcgccaatgttgttagaggtctttggctcatctc

SEQ ID NO: 343957 - DNA, 1228 bp, Homo sapiens
  misc_feature (27)..(27): n is a, c, g, or t
atcccccgggctgcaggattcggcacnagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 343958 - DNA, 1343 bp, Homo sapiens
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 343959 - DNA, 1214 bp, Homo sapiens
  misc_feature (27)..(27): n is a, c, g, or t
atcccccgggctgcaggattcggcacnagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 343960 - DNA, 1246 bp, Homo sapiens
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgctgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 343961 - DNA, 1343 bp, Homo sapiens
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 343962 - DNA, 965 bp, Homo sapiens
cgctgtaggaatacggcacgaggcggagatcagcatgaccagcactcgctgtcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 343963 - DNA, 890 bp, Homo sapiens
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaaggtaatgaacacctgccttt

SEQ ID NO: 343964 - DNA, 1161 bp, Homo sapiens
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagtctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 343965 - DNA, 858 bp, Homo sapiens
  misc_feature (681)..(681): n is a, c, g, or t
  misc_feature (685)..(685): n is a, c, g, or t
  misc_feature (788)..(788): n is a, c, g, or t
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgncggncgccgcagctgagggcatctcacatgctgacgagtgatgtgcctgggagcagacagagccatctaatccagagtcgagggctgctacccagagagaggtcggngtggcactgtactgagcacaggagatctgcagtggctactgcgtctgatggatgacagagatcatatgct

SEQ ID NO: 343966 - DNA, 824 bp, Homo sapiens
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 343967 - DNA, 558 bp, Homo sapiens
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgagaaagaaaagactcccttttggggggggggggaaaaccccctttttttttttttttt

SEQ ID NO: 343968 - DNA, 1397 bp, Homo sapiens
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 343969 - DNA, 880 bp, Homo sapiens
  misc_feature (693)..(694): n is a, c, g, or t
  misc_feature (710)..(711): n is a, c, g, or t
  misc_feature (716)..(716): n is a, c, g, or t
  misc_feature (726)..(726): n is a, c, g, or t
  misc_feature (728)..(728): n is a, c, g, or t
  misc_feature (732)..(732): n is a, c, g, or t
  misc_feature (737)..(737): n is a, c, g, or t
  misc_feature (741)..(741): n is a, c, g, or t
  misc_feature (747)..(747): n is a, c, g, or t
  misc_feature (817)..(817): n is a, c, g, or t
  misc_feature (828)..(828): n is a, c, g, or t
  misc_feature (847)..(847): n is a, c, g, or t
  misc_feature (858)..(858): n is a, c, g, or t
  misc_feature (880)..(880): n is a, c, g, or t
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtganngtgtccctgggagcannaacanagcccatctnantccnagagnccgnaggtgngctaccccagaaaggaagatcaggggtgggcaactggtactgaagtaccaggaagaattctgcaattggntacttgccggncctggtgggaaggaccacnggattctttantgggcatccaggccgtgggttn

SEQ ID NO: 343970 - DNA, 736 bp, Homo sapiens
  misc_feature (27)..(27): n is a, c, g, or t
  misc_feature (572)..(572): n is a, c, g, or t
  misc_feature (574)..(575): n is a, c, g, or t
  misc_feature (579)..(579): n is a, c, g, or t
  misc_feature (581)..(581): n is a, c, g, or t
  misc_feature (596)..(596): n is a, c, g, or t
  misc_feature (602)..(602): n is a, c, g, or t
  misc_feature (610)..(610): n is a, c, g, or t
  misc_feature (673)..(673): n is a, c, g, or t
  misc_feature (684)..(684): n is a, c, g, or t
  misc_feature (703)..(703): n is a, c, g, or t
  misc_feature (714)..(714): n is a, c, g, or t
  misc_feature (736)..(736): n is a, c, g, or t
atcccccgggctgcaggattcggcacnagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacggcgggcgccggagctgagggacttcatctttaccatggctgaccgaggtgaatgtgtccttgggagcaggaccanannccantnttccgagagtccganggctgngcttcccnagaaaaggaagatcaggggtgggcaactggtactgaagtaccaggaagaattctgcaattggntacttgccggncctggtgggaaggaccacnggattctttantgggcatccaggccgtgggttn

SEQ ID NO: 343971 - DNA, 1622 bp, Homo sapiens
  misc_feature (1408)..(1408): n is a, c, g, or t
  misc_feature (1477)..(1477): n is a, c, g, or t
  misc_feature (1496)..(1496): n is a, c, g, or t
  misc_feature (1498)..(1498): n is a, c, g, or t
  misc_feature (1501)..(1502): n is a, c, g, or t
  misc_feature (1515)..(1515): n is a, c, g, or t
  misc_feature (1558)..(1558): n is a, c, g, or t
  misc_feature (1568)..(1568): n is a, c, g, or t
  misc_feature (1571)..(1571): n is a, c, g, or t
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaaaaaaaaaaaaaaaaaaaaaaaagtgagcaactctgttttcaaagcttttgngtggagctgaagcacactgcttattaaagtacactattcaggcatatcatgtaggtttactttctgtgnttctagagaccaagaagcngnacnntcaccatgggagntcgctgtaccttctgattgtggggatcctcatagcatatatanttatacgccnttnccagataacgttgaggagccatggagtgatgtggatcgcactttgctttcc

SEQ ID NO: 343972 - DNA, 1849 bp, Homo sapiens
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaactttggggcccctttggcccaaggcattttagatctgggcaagttaatttttggggcccaaatttgggtttttttggcaaattcccccttaaggggggggtattaaaaataattggcccggtttttaaaaccgtgggattggaaaaacccggggggtccccaatttaaacgctttgggaaaaattccctttttccgagggtgcaaaatacgaaaagggccccacccggtgggcttttccaaaagtggggcaacctttaatgggcaatgggaaaattgtagggggtaaattttttggaaaaaatcccgagaaaattttggttaaaaaagcggtttattttatacaccaaatggggcccaaatcggg

SEQ ID NO: 343973 - DNA, 1459 bp, Homo sapiens
  misc_feature (1333)..(1333): n is a, c, g, or t
  misc_feature (1374)..(1375): n is a, c, g, or t
  misc_feature (1410)..(1410): n is a, c, g, or t
  misc_feature (1422)..(1422): n is a, c, g, or t
  misc_feature (1439)..(1439): n is a, c, g, or t
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgataagagttgttgcgcttttcaactacaacttggccggtttgaagtaaaaggatggccaatgtttttcccgggttcttttgaaagcaaccgccaacaccttgggccaaaattttatnttacatcttctcccctctcttcatttatcattttttttttnntttccctatcctctcttgtggtttttttttacttnccccttttcttnctttttttaatttttcntttttttattatttttattt

SEQ ID NO: 343974 - DNA, 1303 bp, Homo sapiens
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 343975 - DNA, 1422 bp, Homo sapiens
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccggggtacaggaaagcaatagcggcaaggagtctgcaactgcttcttctctttctctcccccgcagaagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 343976 - DNA, 1341 bp, Homo sapiens
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 343977 - DNA, 1082 bp, Homo sapiens
tgatgggaagtttctctatcacaaatccaaatggaacataaccatggagtcctatgtggtccacaccaactatgatgagtatgccattttcctgaccaagaaattcagccgccatcatggacccaccattactgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagtctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 343978 - DNA, 750 bp, Homo sapiens
  misc_feature (1)..(1): n is a, c, g, or t
ngggcacattgggccccccctttttgcaaatttaggggtgtgcccgaggtgaggaacctttcgggactctaaaagggttaccaaggtgtgggcatcctaagtcctcctcttcaccttgcttgacaaggttattgtgtcctgggagcatgaaccaagggccctcttattccgatatgtcggacagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 343979 - DNA, 1028 bp, Homo sapiens
tgatgggaagtttctctatcacaaatccaaatggaacataaccatggagtcctatgtggtccacaccaactatgatgagtatgccattttcctgaccaagaaattcagccgccatcatggacccaccattactgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagtctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 343980 - DNA, 393 bp, Homo sapiens
ctgatcagcagtcacaagggtttctcaagttccatgcctctctccactccacagcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtaggcagccctgcagggtgccaggctgggccgaggggctgttggagtcgaggtgggagagccctgggaggagtaggggtctggagagctgagttctggactctgtacctggtaagcagcccatctactctctgaaatggggctgagcctggggccttaccccag

SEQ ID NO: 343981 - DNA, 274 bp, Homo sapiens
aagttggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaacttttaccccttggtatttgtagaatgcctatacata

SEQ ID NO: 343982 - DNA, 414 bp, Homo sapiens
agatccacaccaaaaaaaaaaaaaaaaaagctactggtagtagtagcagcaaggttactggaaaatcatcagtattaaaaaatcaattgtattcttataaaacttaatatactctgaacatttgatgtggcagtcatgctccttggtattttctcaaataatttgaaaacatatctattgaaaagaaaaacctgcatatagatgtgtgttttgtttttgtttttgttttcttttgagatggagtctcactctgttgcccaggctggagtgcagtggcgtgatcttggctctctgcattctcctcctcctgggttcaagcaattcttgcacctcagcctcctgagtatctgggactgcaggcatgcgccaccatgcccagctaatttttgtatttttagtagagacggggtttca

SEQ ID NO: 343983 - DNA, 487 bp, Homo sapiens
cccaatttcctggctctggcagattgattcctgatggctttccttctcaacattcctgtcttcaggcctttgattttaggcagaggccacagaacactttctcaggtaggaaccaaataggccacacaattagcatctcccacttgccacggtgctgttggatttatggtacttaggaagatggcagtagtcagctcacttcattggtcaagagacagagccacagtaaggctaggaagaaatataaaggtcacttcctgtgctgagcacttcctagagcagccacaggccagcccaccaactactggctgcaattctggaccactccatcgcacagcctacaaatgttttctaactgtcttccgtttttattaaccagtcaagcatgttttactttacactctgataagaggatcagaaacagctttcccacatctaaggcactcttaatcaattgcaaggaatacaagagcagcaccaccagagg

SEQ ID NO: 343984 - DNA, 736 bp, Homo sapiens
gagcatcacctgtctttaaagaaatgaggtgaattgggaaatgtaaaaaaaggataatggctcccagccatactattaaagccattgcatatgtactttcacacacttagagaaaggacaaaaataaacctatgtcattgtcacttaatatcctttatgaaacagtaacaattactatattacattttgatctttaaagctctgtgtgatgaagtgggaaatgtgcctaaaatgcttctgctgcggacgaaagtggaagaagagtacttgtgcagttttttgagttccaagctgaatttgctttttttcatagaaaactattttacttgaaactatggttttacttaaaaactatggtttttaggcatgggtatttggcagccattttctcagaagtgaatgaattgagcctgtcatttccaggaaaacaactgacatatgttgccagtgataaaaattgagattttaaatgaaaattagaattttggaaaattggtatttgctgccatgagctggtcagtttctcagtatttaaagactttcctgaagagattggtggtgatattaatgaacgtgaatttttttgatattgtgtaatgtcaacatttcaaagatctgcgtagcttattgcaatatattctaaatgagaaatgcatgatgttaagtgcaaaacagagcaataataaatagattgtattttattttattatttttattttttgagatggagtcttgc

SEQ ID NO: 343985 - DNA, 1422 bp, Homo sapiens
ctcgcgaacgtgttatcccaggcatggtggacagagcgagaccctgtgggggttaggatttcaacataagaattttgcggggagtggacacaattcattccataacacatatgttcagctttagtagagtctcccagtgccgccaagtggttgtaccagttaacactccttccaggagtcaaagggagttctaattgttccacatcctccccaaatacttgatattttgtgtgttttaaataaatcttccttaaacaaaaaaaaacaaataaataaatatcttcaaagaattgaagggaaaccatacttaaagaggtaaagaaagatgtgaagatgatgtcttatcaaatagagaatattgataaagagatagaaactagttttaaaagaggcccaaatggaaattctgaagtttaaaagtaggataaccgaaatgcaaaattcattaggctgggtaccgtggcttatgcctgaatctcagtgctttgagagatggaggcaggagaattgcttaagcccaggagttcaagaccagcctgagcacgtagtgagaccctatctctacaaaaaattttaaaaacttaggccaggcacagtggctcatgcctgtaatcccagcactttgggaggctgaggcaggcagatcacttgggatcaggagtttgagatcagcctggccaacatggtgaaatctcgtctctactaaaaatataaaaattagctgggtgtggcggcacacgcctgtaatcctggctatttggaaggctaaggcaggagaatcgcttgaacccagtaggcggaggttgcagtgagccgagatcgcaccactgtactccagcctggacgagggagtaagactccatctcaaaaaaaataataataattaaatttagctgggcatggtggcacacacctgtgatcccagctactcaggaggctgaggtgggaagattgcttgagtccaagaggttgaggttgcagcaagccatgatcatgccactgcgcttcaggtgggcaagaaagcaagaccctttctcaaaggacgacagaaaacttcattaaaggggctcaatagtagatttgagctggcagaagaaacgatcagtgaacatgaaaatagattgaaagagatttggtcaggcacagtggctcatgcctgtaatcccagcattttgggaggctgaggcaggcgaatcacgaggtcaggagatcgagaccatcctggctaacatggtgaaaccccgtctctactatatacaaaaaaaaaattagccaggtgtggtggcgggcacctgtagtcccagctactcgggaggctgaggcaggagaatggtgtgaacctgggaggcggaggttgcagtgagctgagattgtgccactgcactccagcctgggcaacagagtgagattccatctcaaaaa

SEQ ID NO: 343986 - DNA, 1282 bp, Homo sapiens
ggacagaaggaatttaaacccaatctttgcctgcgaaccgactgggtttgctctgtggatttccaagcgtcttttgcccggggctttgttaaggattggttgagtttcaagccccagggctcaggtagaaagcagagtgctacctccagcccccaccctgctgcactcagagccctggactctgccgggagaagcctgttgcggaggaacggggcccgggaaggaggtctgtcgctgactcttggctgtttgtcaggtggacgacatccttggagaaggcagcgacgacagcgacagcgagaagaggaggcctgaggagcaggaggaggagccccagccccggaagccagggacccgcagggagcggacgctcggggcacctgcgtccagcgagaggagcgcggcagggggccgggggcccagaggccacaagaggaagctgaatgaagaggacgccgccagcgagtccagcagggagtccagcaacgaggacgagggcagcagctccgaggccgacgagatggccaaggcgctggaggcggagctcaacgacctcatgtgagcgcgggcagcgggcagggactgaagcctgaccgacctccagcagcactcggacgtccccggaccagccctcagtctcggtccacgctgctttcttcccaaaggacatgtatatttgcagagctccacatacagaaacacattattttgcagaaataggtgtttttaagaagttttactacaggaatgtctacttttgtaagtgacaggtgttaaaggcccaggtgtgctgtgccaaagagctcagcagaggctcacgtggcccaggctggtgcgcccgctgtctcggtaaggggcgggttggtgtgttttccccttgtgtaccagagcacattccttaggggacggctttgggggtcccacgagacatggactaggagtttaagcaggacagtgtgcgtgcacgagctccgagcccagcacagacatgcctggaacccccgccgcctgctgctccctcctagggaacccatttccggggaacgccgtgactgtcgggcagcctggagcttcctgcagcctcctacgcagggtccacgccacgtggcctgggctgccatcctgccgtcctcccactggcatcctggcaagggggcgttgcttttcctgggcggccttttatgtcttggagacacctgatgtaaagtttctgtaaatctatttcatatctgacccaccaaacagatttctctttaataaaaatcctttttgtaagttctct

SEQ ID NO: 343987 - DNA, 3527 bp, Homo sapiens
  misc_feature (264)..(264): n is a, c, g, or t
  misc_feature (400)..(400): n is a, c, g, or t
ctgggttgtgtcgccgcggtaggcgctgcgctctgagcgcagcgcaggccccgtaccgaccgcccgcccgccctctgtccgcgatggaggtgccggccgcgggtcgcgttcctgccgagggcgccccgacggcggctgtggccgaggtgcgctgcccggggcccgcgccgctgcgcctgctggagtggagggtggcggcgggcgcggccgtgcgcatcggctcggtgctggccgtgttcgaggccgccgcctccgcgcagtccnccggggcctctcagtcccgtgtagcctccgggggctgcgtgcgccccgcgcggccggaacgcaggctgaggtcggagcgcgcgggcgtggtgcgggagctgtgcgcgcagccgggccaggtggtcgccccaggagnggttctggtgaggttggaaggatgcagccacccggttgtcatgaaaggcctgtgtgctgaatgtggccaagacctcacccagttgcagagtaagaacgggaagcagcaggtgccgctgtccacggcgaccgtgtccatggtgcacagcgtcgccggagttgatggtgagctccgagcaagctgaacagctgggaagagaagaccagcagcgactgcaccgaaaccggaagctggtgctcatggtggacttggaccagacgttgattcacacaaccgagcagcactgtcagcagatgtcgaataaaggcatctttcacttccagctgggccggggtgagcccatgctgcacacgcgcctgcgtccacactgcaaggacttcctggagaagatcgccaagctgtacgagctgcacgtcttcaccttcggcagccggctgtacgcacacaccatcgcaggctttttagaccccgagaagaagcttttttctcaccgaatattatcaagggatgaatgtattgacccattttctaaaacgggaaaccttagaaatctctttccttgtggagactcaatggtttgcattattgatgatcgagaagatgtctggaagtttgcccccaatctgataactgtgaagaaatatgtatacttccagggcacaggtgatatgaatgcgccccctgggtcccgagaatctcagacgagaaagaaagtaaatcattctcgaggcactgaggtctcagagccatctccgcccgtgagagaccctgagggggtaacgcaggcccctggagtggagcccagcaatggcctggagaagcctgcacgggagctgaacggcagcgaggccgccaccccgcgggactcaccccgccccgggaagccagacgagagggacatctggccccctgcccaggcccccaccagcagccaagagctggcaggcgctcctgagccccagggatcctgtgcgcagggtggccgggtggcaccgggacagcggcctgcccagggtgccacgggcactgacctggactttgacttatccagcgacagcgagagcagcagtgagtccgagggcacgaagtcctcctcctccgcctctgatggcgaaagcgaggggaaaagaggccggcagaagccgaaggctgccccagagggagccggggcgctggcacagggcagttccctggagccggggcggcctgcagcaccgagtctccccggagaggccgagcctggcgcgcatgccccggacaaggagcctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgacgcccctgacagggccacgcacctgatcgccgcgcgagctggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacagagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcaggtggacgacatccttggagaaggcagcgacgacagcgacagcgagaagaggaggcctgaggagcaggaggaggagccccagccccggaagccagggacccgcagggagcggacgctcggggcacctgcgtccagcgagaggagcgcggcagggggccgggggcccagaggccacaagaggaagctgaatgaagaggacgccgccagcgagtccagcagggagtccagcaacgaggacgagggcagcagctccgaggccgacgagatggccaaggcgctggaggcggagctcaacgacctcatgtgagcgcgggcagcgggcagggactgaagcctgaccgacctccagcagcactcggacgtccccggaccagccctcagtctcggtccacgctgctttcttcccaaaggacatgtatatttgcagagctccacatacagaaacacattattttgcagaaataggtgtttttaagaagttttactacaggaatgtctacttttgtaagtgacaggtgttaaaggcccaggtgtgctgtgccaaagagctcagcagaggctcacgtggcccaggctggtgcgcccgctgtctcggtaaggggcgggttggtgtgttttccccttgtgtaccagagcacattccttaggggacggctttgggggtcccacgagacatggactaggagtttaagcaggacagtgtgcgtgcacgagctccgagcccagcacagacatgcctggaacccccgccgcctgctgctccctcctagggaacccatttccggggaacgccgtgactgtcgggcagcctggagcttcctgcagcctcctacgcagggtccacgccacgtggcctgggctgccatcctgccgtcctcccactggcatcctggcaagggggcgttgcttttcctgggcggccttttatgtcttggagacacctgatgtaaagtttctgtaaatctatttcatatctgacccaccaaacagatttctctttaataaaaatcctttttgtaagttctct

SEQ ID NO: 343988 - DNA, 1555 bp, Homo sapiens
ccccccgtccccactacccccaccatacctagtagctggtttgatcggacgaggactgcacgtggtcaaccctgactggctgtggagctgcctggagcgctgggacaaggtggaggagcagctcttcccgctcagggacgatcacaccaaggcacagagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcagagcggttccgccaccccagccgcagatgtttggtgaagagctgcctgacgctcaggacggagagcagcctggcccttctagaagaaagcgacagcccagtatgtctgagacaatgccgctgtacactctttgtaaggaggatttagagagtatggacaaagaggtggacgacatccttggagaaggcagcgacgacagcgacagcgagaagaggaggcctgaggagcaggaggaggagccccagccccggaagccagggacccgcagggagcggacgctcggggcacctgcgtccagcgagaggagcgcggcagggggccgggggcccagaggccacaagaggaagctgaatgaagaggacgccgccagcgagtccagcagggagtccagcaacgaggacgagggcagcagctccgaggccgacgagatggccaaggcgctggaggcggagctcaacgacctcatgtgagcgcgggcagcgggcagggactgaagcctgaccgacctccagcagcactcggacgtccccggaccagccctcagtctcggtccacgctgctttcttcccaaaggacatgtatatttgcagagctccacatacagaaacacattattttgcagaaataggtgtttttaagaagttttactacaggaatgtctacttttgtaagtgacaggtgttaaaggcccaggtgtgctgtgccaaagagctcagcagaggctcacgtggcccaggctggtgcgcccgctgtctcggtaaggggcgggttggtgtgttttccccttgtgtaccagagcacattccttaggggacggctttgggggtcccacgagacatggactaggagtttaagcaggacagtgtgcgtgcacgagctccgagcccagcacagacatgcctggaacccccgccgcctgctgctccctcctagggaacccatttccggggaacgccgtgactgtcgggcagcctggagcttcctgcagcctcctacgcagggtccacgccacgtggcctgggctgccatcctgccgtcctcccactggcatcctggcaagggggcgttgcttttcctgggcggccttttatgtcttggagacacctgatgtaaagtttctgtaaatctatttcatatctgacccaccaaacagatttctctttaataaaaatcctttttgtaagttctct

SEQ ID NO: 343989 - DNA, 1404 bp, Homo sapiens
gaaagcctagtggtactggctggttatgcagaggctcgtaaggaaagcctagtggcaccggctggttatgcagagggctggtgttctctttgtttattaagagtcattttagcagtggcctgaggaaatgagaatttccagaccgtggcccacttgatgagctgggaggtgcttgttcacataacactaatagttactctgacagatgatcttaacttccctgtcctgttttcctgttctgatgtcttctggcatcacaggtgttcatgagcggccggaacgtgcatttgcagcaggtgaacacctgctttgtcagtggtgtcctggtgtgtaacagggctggggcctcttctcctgcgctggggctctgctgtccacacgtgtgtgacgtggccctgggtcggtggcctgtgtgtgtccttgaccagagaattgtgccgtcttgtgttaaaaccacggaagccacttcccaaatgcagaccaggcggtgacccggcgttgtgcgtttgccacaagcatctcacaccatgtttgcttctctgcagaggccacaagaggaagctgaatgaagaggacgccgccagcgagtccagcagggagtccagcaacgaggacgagggcagcagctccgaggccgacgagatggccaaggcgctggaggcggagctcaacgacctcatgtgagcgcgggcagcgggcagggactgaagcctgaccgacctccagcagcactcggacgtccccggaccagccctcagtctcggtccacgctgctttcttcccaaaggacatgtatatttgcagagctccacatacagaaacacattattttgcagaaataggtgtttttaagaagttttactacaggaatgtctacttttgtaagtgacaggtgttaaaggcccaggtgtgctgtgccaaagagctcagcagaggctcacgtggcccaggctggtgcgcccgctgtctcggtaaggggcgggttggtgtgttttccccttgtgtaccagagcacattccttaggggacggctttgggggtcccacgagacatggactaggagtttaagcaggacagtgtgcgtgcacgagctccgagcccagcacagacatgcctggaacccccgccgcctgctgctccctcctagggaacccatttccggggaacgccgtgactgtcgggcagcctggagcttcctgcagcctcctacgcagggtccacgccacgtggcctgggctgccatcctgccgtcctcccactggcatcctggcaagggggcgttgcttttcctgggcggccttttatgtcttggagacacctgatgtaaagtttctgtaaatctatttcatatctgacccaccaaacagatttctctttaataaaaatcctttttgtaagttctct

SEQ ID NO: 343990 - DNA, 219 bp, Homo sapiens
cacttatcaacatggtttgtgtttgagaaataagttcaccataagagaaaagaagccccacacgagccacgtcttacctcaaaagggatgaagtgtttggtgccagttcatcatgttgtgtgtctgccactttaaaaaaaacattcaaggcttcaccatgtgccgtgtgaccgaaacgtgtctcaggtatgtaatctttgtcctgttttcttttccaag

SEQ ID NO: 343991 - DNA, 390 bp, Homo sapiens
gaggtgcagccgagtgagggccttggtggggtgcagccgggtgagggccctggtggggtacagctgggtgagggccctgagccctgcaggggtgcagtcaggtgaaggccctggtgggatgcagccgagtgagggccctgagccctggtggggtacagccaggtgagggccctggtgggtgcagccggatgtgggccctgagcctccagtgctggccggaacagcctgacgcagccgggtctcctgcaggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacaga

SEQ ID NO: 343992 - DNA, 3690 bp, Homo sapiens
  misc_feature (264)..(264): n is a, c, g, or t
  misc_feature (400)..(400): n is a, c, g, or t
ctgggttgtgtcgccgcggtaggcgctgcgctctgagcgcagcgcaggccccgtaccgaccgcccgcccgccctctgtccgcgatggaggtgccggccgcgggtcgcgttcctgccgagggcgccccgacggcggctgtggccgaggtgcgctgcccggggcccgcgccgctgcgcctgctggagtggagggtggcggcgggcgcggccgtgcgcatcggctcggtgctggccgtgttcgaggccgccgcctccgcgcagtccnccggggcctctcagtcccgtgtagcctccgggggctgcgtgcgccccgcgcggccggaacgcaggctgaggtcggagcgcgcgggcgtggtgcgggagctgtgcgcgcagccgggccaggtggtcgccccaggagnggttctggtgaggttggaaggatgcagccacccggttgtcatgaaaggcctgtgtgctgaatgtggccaagacctcacccagttgcagagtaagaacgggaagcagcaggtgccgctgtccacggcgaccgtgtccatggtgcacagcgtcgccggagttgatggtgagctccgagcaagctgaacagctgggaagagaagaccagcagcgactgcaccgaaaccggaagctggtgctcatggtggacttggaccagacgttgattcacacaaccgagcagcactgtcagcagatgtcgaataaaggcatctttcacttccagctgggccggggtgagcccatgctgcacacgcgcctgcgtccacactgcaaggacttcctggagaagatcgccaagctgtacgagctgcacgtcttcaccttcggcagccggctgtacgcacacaccatcgcaggctttttagaccccgagaagaagcttttttctcaccgaatattatcaagggatgaatgtattgacccattttctaaaacgggaaaccttagaaatctctttccttgtggagactcaatggtttgcattattgatgatcgagaagatgtctggaagtttgcccccaatctgataactgtgaagaaatatgtatacttccagggcacaggtgatatgaatgcgccccctgggtcccgagaatctcagacgagaaagaaagtaaatcattctcgaggcactgaggtctcagagccatctccgcccgtgagagaccctgagggggtaacgcaggcccctggagtggagcccagcaatggcctggagaagcctgcacgggagctgaacggcagcgaggccgccaccccgcgggactcaccccgccccgggaagccagacgagagggacatctggccccctgcccaggcccccaccagcagccaagagctggcaggcgctcctgagccccagggatcctgtgcgcagggtggccgggtggcaccgggacagcggcctgcccagggtgccacgggcactgacctggactttgacttatccagcgacagcgagagcagcagtgagtccgagggcacgaagtcctcctcctccgcctctgatggcgaaagcgaggggaaaagaggccggcagaagccgaaggctgccccagagggagccggggcgctggcacagggcagttccctggagccggggcggcctgcagcaccgagtctccccggagaggccgagcctggcgcgcatgccccggacaaggagcctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgacgcccctgacagggccacgcacctgatcgccgcgcgagctggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacagagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcagagcggttccgccaccccagccgcagatgtttggtgaagagctgcctgacgctcaggacggagagcagcctggcccttctagaagaaagcgacagcccagtatgtctgagacaatgccgctgtacactctttgtaaggaggatttagagagtatggacaaagaggtggacgacatccttggagaaggcagcgacgacagcgacagcgagaagaggaggcctgaggagcaggaggaggagccccagccccggaagccagggacccgcagggagcggacgctcggggcacctgcgtccagcgagaggagcgcggcagggggccgggggcccagaggccacaagaggaagctgaatgaagaggacgccgccagcgagtccagcagggagtccagcaacgaggacgagggcagcagctccgaggccgacgagatggccaaggcgctggaggcggagctcaacgacctcatgtgagcgcgggcagcgggcagggactgaagcctgaccgacctccagcagcactcggacgtccccggaccagccctcagtctcggtccacgctgctttcttcccaaaggacatgtatatttgcagagctccacatacagaaacacattattttgcagaaataggtgtttttaagaagttttactacaggaatgtctacttttgtaagtgacaggtgttaaaggcccaggtgtgctgtgccaaagagctcagcagaggctcacgtggcccaggctggtgcgcccgctgtctcggtaaggggcgggttggtgtgttttccccttgtgtaccagagcacattccttaggggacggctttgggggtcccacgagacatggactaggagtttaagcaggacagtgtgcgtgcacgagctccgagcccagcacagacatgcctggaacccccgccgcctgctgctccctcctagggaacccatttccggggaacgccgtgactgtcgggcagcctggagcttcctgcagcctcctacgcagggtccacgccacgtggcctgggctgccatcctgccgtcctcccactggcatcctggcaagggggcgttgcttttcctgggcggccttttatgtcttggagacacctgatgtaaagtttctgtaaatctatttcatatctgacccaccaaacagatttctctttaataaaaatcctttttgtaagttctct

SEQ ID NO: 343993 - DNA, 3620 bp, Homo sapiens
  misc_feature (264)..(264): n is a, c, g, or t
  misc_feature (400)..(400): n is a, c, g, or t
ctgggttgtgtcgccgcggtaggcgctgcgctctgagcgcagcgcaggccccgtaccgaccgcccgcccgccctctgtccgcgatggaggtgccggccgcgggtcgcgttcctgccgagggcgccccgacggcggctgtggccgaggtgcgctgcccggggcccgcgccgctgcgcctgctggagtggagggtggcggcgggcgcggccgtgcgcatcggctcggtgctggccgtgttcgaggccgccgcctccgcgcagtccnccggggcctctcagtcccgtgtagcctccgggggctgcgtgcgccccgcgcggccggaacgcaggctgaggtcggagcgcgcgggcgtggtgcgggagctgtgcgcgcagccgggccaggtggtcgccccaggagnggttctggtgaggttggaaggatgcagccacccggttgtcatgaaaggcctgtgtgctgaatgtggccaagacctcacccagttgcagagtaagaacgggaagcagcaggtgccgctgtccacggcgaccgtgtccatggtgcacagcgtcgccggagttgatggtgagctccgagcaagctgaacagctgggaagagaagaccagcagcgactgcaccgaaaccggaagctggtgctcatggtggacttggaccagacgttgattcacacaaccgagcagcactgtcagcagatgtcgaataaaggcatctttcacttccagctgggccggggtgagcccatgctgcacacgcgcctgcgtccacactgcaaggacttcctggagaagatcgccaagctgtacgagctgcacgtcttcaccttcggcagccggctgtacgcacacaccatcgcaggctttttagaccccgagaagaagcttttttctcaccgaatattatcaagggatgaatgtattgacccattttctaaaacgggaaaccttagaaatctctttccttgtggagactcaatggtttgcattattgatgatcgagaagatgtctggaagtttgcccccaatctgataactgtgaagaaatatgtatacttccagggcacaggtgatatgaatgcgccccctgggtcccgagaatctcagacgagaaagaaagtaaatcattctcgaggcactgaggtctcagagccatctccgcccgtgagagaccctgagggggtaacgcaggcccctggagtggagcccagcaatggcctggagaagcctgcacgggagctgaacggcagcgaggccgccaccccgcgggactcaccccgccccgggaagccagacgagagggacatctggccccctgcccaggcccccaccagcagccaagagctggcaggcgctcctgagccccagggatcctgtgcgcagggtggccgggtggcaccgggacagcggcctgcccagggtgccacgggcactgacctggactttgacttatccagcgacagcgagagcagcagtgagtccgagggcacgaagtcctcctcctccgcctctgatggcgaaagcgaggggaaaagaggccggcagaagccgaaggctgccccagagggagccggggcgctggcacagggcagttccctggacctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgacgcccctgacagggccacgcacctgatcgccgcgcgagctggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacagagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcagagcggttccgccaccccagccgcagatgtttggtgaagagctgcctgacgctcaggacggagagcagcctggcccttctagaagaaagcgacagcccagtatgtctgagacaatgccgctgtacactctttgtaaggaggatttagagagtatggacaaagaggtggacgacatccttggagaaggcagcgacgacagcgacagcgagaagaggaggcctgaggagcaggaggaggagccccagccccggaagccagggacccgcagggagcggacgctcggggcacctgcgtccagcgagaggagcgcggcagggggccgggggcccagaggccacaagaggaagctgaatgaagaggacgccgccagcgagtccagcagggagtccagcaacgaggacgagggcagcagctccgaggccgacgagatggccaaggcgctggaggcggagctcaacgacctcatgtgagcgcgggcagcgggcagggactgaagcctgaccgacctccagcagcactcggacgtccccggaccagccctcagtctcggtccacgctgctttcttcccaaaggacatgtatatttgcagagctccacatacagaaacacattattttgcagaaataggtgtttttaagaagttttactacaggaatgtctacttttgtaagtgacaggtgttaaaggcccaggtgtgctgtgccaaagagctcagcagaggctcacgtggcccaggctggtgcgcccgctgtctcggtaaggggcgggttggtgtgttttccccttgtgtaccagagcacattccttaggggacggctttgggggtcccacgagacatggactaggagtttaagcaggacagtgtgcgtgcacgagctccgagcccagcacagacatgcctggaacccccgccgcctgctgctccctcctagggaacccatttccggggaacgccgtgactgtcgggcagcctggagcttcctgcagcctcctacgcagggtccacgccacgtggcctgggctgccatcctgccgtcctcccactggcatcctggcaagggggcgttgcttttcctgggcggccttttatgtcttggagacacctgatgtaaagtttctgtaaatctatttcatatctgacccaccaaacagatttctctttaataaaaatcctttttgtaagttctct

SEQ ID NO: 343994 - DNA, 3043 bp, Homo sapiens
  misc_feature (264)..(264): n is a, c, g, or t
  misc_feature (400)..(400): n is a, c, g, or t
ctgggttgtgtcgccgcggtaggcgctgcgctctgagcgcagcgcaggccccgtaccgaccgcccgcccgccctctgtccgcgatggaggtgccggccgcgggtcgcgttcctgccgagggcgccccgacggcggctgtggccgaggtgcgctgcccggggcccgcgccgctgcgcctgctggagtggagggtggcggcgggcgcggccgtgcgcatcggctcggtgctggccgtgttcgaggccgccgcctccgcgcagtccnccggggcctctcagtcccgtgtagcctccgggggctgcgtgcgccccgcgcggccggaacgcaggctgaggtcggagcgcgcgggcgtggtgcgggagctgtgcgcgcagccgggccaggtggtcgccccaggagnggttctggtgaggttggaaggatgcagccacccggttgtcatgaaaggcctgtgtgctgaatgtggccaagacctcacccagttgcagagtaagaacgggaagcagcaggtgccgctgtccacggcgaccgtgtccatggtgcacagcgtcgccggagttgatggtgagctccgagcaagctgaacagctgggaagagaagaccagcagcgactgcaccgaaaccggaagctggtgctcatggtggacttggaccagacgttgattcacacaaccgagcagcactgtcagcagatgtcgaataaaggcatctttcacttccagctgggccggggtgagcccatgctgcacacgcgcctgcgtccacactgcaaggacttcctggagaagatcgccaagctgtacgagctgcacgtcttcaccttcggcagccggctgtacgcacacaccatcgcaggctttttagaccccgagaagaagcttttttctcaccgaatattatcaagggatgaatgtattgacccattttctaaaacgggaaaccttagaaatctctttccttgtggagactcaatggtttgcattattgatgatcgagaagatgtctggaagtttgcccccaatctgataactgtgaagaaatatgtatacttccagggcacaggtgatatgaatgcgccccctgggtcccgagaatctcagacgagaaagaaagtaaatcattctcgaggcactgaggtctcagagccatctccgcccgtgagagaccctgagggggtaacgcaggcccctggagtggagcccagcaatggcctggagaagcctgcacgggagctgaacggcagcgaggccgccaccccgcgggactcaccccgccccgggaagccagacgagagggacatctggccccctgcccaggcccccaccagcagccaagagctggcaggcgctcctgagccccagggatcctgtgcgcagggtggccgggtggcaccgggacagcggcctgcccagggtgccacgggcactgacctggactttgacttatccagcgacagcgagagcagcagtgagtccgagggcacgaagtcctcctcctccgcctctgatggcgaaagcgaggggaaaagaggccggcagaagccgaaggctgccccagagggagccggggcgctggcacagggcagttccctggagccggggcggcctgcagcaccgagtctccccggagaggccgagcctggcgcgcatgccccggacaaggagcctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgacgcccctgacagggccacgcacctgatcgccgcgcgagctggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacagagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcagagcggttccgccaccccagccgcagatgtttggtgaagagctgcctgacgctcaggacggagagcagcctggcccttctagaagaaagcgacagcccagtatgtctgagacaatgccgctgtacactctttgtaaggaggatttagagagtatggacaaagaggtggacgacatccttggagaaggcagcgacgacagcgacagcgagaagaggaggcctgaggagcaggaggaggagccccagccccggaagccagggacccgcagggagcggacgctcggggcacctgcgtccagcgagaggagcgcggcagggggccgggggcccagttctcaaaacggagtgaggtggaggaagcctaatgggaggatgggagccgggttttcccggaacagccgtcagcgtgtatgcggaggaaaagagatgactgatgaatttgttaattgccaaaagcttgttgctgtagcaaccggaggccagactcgtggccctgacagcgtcgttagtgtcagcagagactggaaataaaggaaactcgtgt

SEQ ID NO: 343995 - DNA, 1793 bp, Homo sapiens
aggggtgttgcccaggatggtggagaggagaggagaggagaccaggtcatagcagaaactagctagggagcatttgccttcaaagaacacttttgaagttggtttgacattagaattccaaatccatagtatcacaaagcagatgtcttacattatgatgtatatgcttgttggttgcctctctgcatcaggcactgtgctgcgtgcttcatgggcatgatcccattccatgtttgcagccactctgcagagggctgctttggtggttgagggctctacccctgacatcacactgctagttttcatatcttagctctgccacttgtaggttgtgacctttaaacctctctaagcctcagttttctcatctgtaaagtgggaataatcatgcatctgtcctatcttacaaggttggtatgacttgtaaactatgaacgtctatgtaagtgtactagttgttattttggttcatacctcatgtcccatttgagtacacagtaagcagttttcaactgggggcagtttgcttccccacaagacatttggcaacatatggagacatttttggtcatcacagctggggcggagagtgcaattgacatgcagtggattgaggccactgagcatcctacagcgctgctaggacaatgctgctcaacaccccacaatgcacagggcagtctccacaacacagactgtggtgtgtgtgtttggagggcgtgtctcaaggaagagaagtaaaatacaatacaaaacaaaacctcgttgttgagtattaagcaatgcaaacaaaagcagggaagaggcgaggcacagaaaacaagagaagtctgacgtgcaaaccatgattcatgtaggtcacagaaatcatttaccttcaattgtgtttggcataatgttgaactaaagttgaaatcagtgcattctgtacacattagactgtcttctgctccctagcacagtgtctaccatccatgtgcatcctctctgctccaagaatagacagagaacaaattcacacagactcatttgcacagaatcccatgtatagcttgagtctttctgtttctttcttaaggccctcatcaaagcctgtgtggagtcagtcttttttctctactggactataagctttcaccagagtccaccccaaactgtacatggttctatgggttttatcaacaatgtaagactggaaacctcttgaaggtagatgtttctttgcaggtcactgctgtctgcccacgtcattttttcaggcacagggcagatgactgacactttgatgaattagcgaatggagcagaactcctggagcccatggtggaagcttcattgctcatgaatcacaaaaccattggttttgatagagagaaatctaaagggatggacagaacagcaagaacagtttctgccaattccatgctttggggacagattatgtcagtagaatcaaggcagtttaaggttgtgcttgaagcccatcttactaattttactaataggaatgcttacctgcttataagtgtggtgtggcaaagttgtgtgagaagctgggaaagacatccctaggacaagtaaacaccttgccaaatcccaaataaagggaagtggtaggactggaaaggaaatggatattctgtggaagaaacactttgtcatcccagacagggatttgtcataatgaagcctttcctggaaagaagtgttaaaactagggcatgtagaggtatgtcatggacctgagaatctcaaaatttgaagaataaagaaccaagcaggtacacgtggca

SEQ ID NO: 343996 - DNA, 426 bp, Homo sapiens
ctttttttttctttctgagacaaggtctctctctgccatccagactggagtgcagtggtgcaatcatggctcattgcagccttgaccttccaggctcaagcaatcctcccacatcagcctcccaagtagctggaaccacaggcatgcaccacgatggccagctaatatttctgtagagatggggtctccctatgttgcccaggctggtctcaaactcctaggctcaagtcatcctccttcctcggcctcccaaaatgctgggattacaggtgtgatcagcctgtaccaccatgccttgtctaaaatattacttttgtcctgctgaggaataaaagtaaggaaaagaaatcaatttatgtaactaattatttacctaactattagaaaccaacataccctacttcctctcagactccaagtcgactt

SEQ ID NO: 343997 - DNA, 1483 bp, Homo sapiens
gccgtttagggccgggtcttggcccgtcgcccacggtgcggagggctggtgggctttccttggccgtcgggcccgccacggcgcgggtcttggctgcggggcggaggtggggcgggagagccgaggataagagtttgaggcttttcgaggcgcgtgccgcggcgtccgcctctgcgggactctgcgccgggcgccctcggccggcgcgcccggctcccgctttgtcgccgagggaagcacgcgcgacgcccctcccgtcgccgccgtggcttctttcggtgttcgtgatttgctgagaggctggaaagcagcacggcggagaggagccttgcactcgccaggcgggaagcctgcgcggacacgcgtgcgcacccacggggcggcgggcgggcgtggggggtccgggccacgcgggcgacgcgcctctagggaagcgatcttgttgcaccttcccgttattctgaaagcaaatcgtagccagacccgagcgcagcggcttagcaaataataaggggagcgtcagtcgtgctcgaaatgcttccttcgcgatggcgtcagtgttccgtgagggaatgaagccgcagtaggaaataaagaggctgtgcgcgtagtctgaaaagcagaagtcaacatttttacagatgaagaaagaatacggaggcaagaggtctttctctgcagtttggtggatttccaacatttagacttgtttggaagaatttcctcagctgcaccaatgaagtccttgatctatagaagtcggcagtccctaaatctacgtctgcattttgttgcaaatcctttataacattccattaaaataatgcagagttatttaatatccagttggccatcgtgagagtaattcgcggctgagattttgttaatcattctgtcttctgacttaacagtgaacgtaggtgattttttttgtaaaatgttgcttcacatgaattgtgagaatcacctctaagtttgaattgtactgaaggcactataagaatttcaaatgaacgctgagtagccagtagccttctggccttttcgtttaacaagcacagagttcgtttttaaaattaagttactttgacagaggaaatgtaatagccttggtagacaacattaaaaatgtaactgtcagatgttttaaagtctccaacagccgtatctgttttagagccatagaatatttacttactgaattgcctgtttaaagatgaactttctaaatgcagggaatagtaacttgcaaaaaagctatggtctctaagtaatgaaggctgtttcagtacctagaaaaatcaaaatcaaggttttgatgctgctagtgtaaaagatgcaatccccttcttaatggcctgcttatttattaagctcctaggcactatgctgaatgccctacatgcatatctcgtttaatcatcagtacaacttgggcttaggttagactgttatccccattttacaaataaggggaaaccca

SEQ ID NO: 343998 - DNA, 841 bp, Homo sapiens
gccgtttagggccgggtcttggcccgtcgcccacggtgcggagggctggtgggctttccttggccgtcgggcccgccacggcgcgggtcttggctgcggggcggaggtggggcgggagagccgaggataagagtttgaggcttttcgaggcgcgtgccgcggcgtccgcctctgcgggactctgcgccgggcgccctcggccggcgcgcccggctcccgctttgtcgccgagggaagcacgcgcgacgcccctcccgtcgccgccgtggcttctttcggtgttcgtgatttgctgagaggctggaaagcagcacggcggagaggagccttgcactcgccaggcgggaagcctgcgcggacacgcgtgcgcacccacggggcggcgggcgggcgtggggggtccgggccacgcgggcgacgcgcctctagggaagcgatcttgttgcaccttcccgttattctgaaagcaaatcgtagccagacccgagcgcagcggcttagcaaataataaggggagcgtcagtcgtgctcgaaatgcttccttcgcgatggcgtcagtgttccgtgagggaatgaagccgcagtaggaaataaagaggctgtgcgcgtagtctgaaaagcagaagtcaacatttttacagatgaagaaagaatacggaggcaagaggtctttctctgcagtttggtggatttccaacatttagacttgtttggaagaatttcctcagctgcaccaatgaagtccttgatctatagaagtcggcagtccctaaatctacgtctgcattttgttgcaaatcctttataacattccattaaaataatgcagagttatttaata

SEQ ID NO: 343999 - DNA, 312 bp, Homo sapiens
acagttttattaggcatgctggaaccagacctcccatcctcacactgtggtgtcagggacttctgcctcatgtgtcttttcaaataataacaatatgctgtacccaaagtatatggtaccagtttagagtcttgaattttaaaaacctgaatatggaaagaacctgcccatccactttggaatgcccctgttaagctcaccttacagcatcagaagtggactcagcagccacctattagatccaatatgaaatgccctaaatactccccttacgtggtgcctggaggacctcagtcttaagcttctcctttg

SEQ ID NO: 344000 - DNA, 554 bp, Homo sapiens
tcccgaggatagaaaaacactaggaagcctcttctgtaacactgatataaggcagattttgtttcagttgttttgatctccaacagtaagttgtgcccatggcagaagtgggtataatctatctagattaaaataatgccatgtttttcaaaataactaaaattataataaagcttcaaaagattataacagaagagttggtccatgggcatgggccaggttcaaggatactttgtggactggccacttatgcagcacatccttaaagccagagaacattaagactcacttagacaaggaaaaacggctccccattacactgcctgaagttgcagaaaagatgaaagtttgttagctttctcttctatatcctactcccttcctttctcatggatctttcgtttccagattccatttttacttctctgtgtgacttagttccacatctctcaatacagctagaaattttcactcggggtttgtcacctcaaacctgtcatctctaaacctgtactcatgtttccaacaaaactgtcttcccccctggaagtaca

SEQ ID NO: 344001 - DNA, 4722 bp, Homo sapiens
tgcgcagacgccgtcgccgccgctgctgccgccgccgctgccacagcctttgccgccacggtctccgccgccgctgtcctcgcgctgcctctgggagcctccattgttccagcagcgcccggtcccgagaccgggcatcttgggggctcgcgaaacgggcggcggccgacggagttgagaccccagggcgccggcgggaccaggagcggcaggggtcagctcaggaatcccggggagccgggaccaaagcgtggggcggcagggggccggggtggcgaggtctacggtctccggagttggggctcccccttcccggcccgactttccccgccgacctccccaagtggggtcggagccccggcgggcgcccccggcgatgagcccggactcgaggtggccgatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggaggtggacttgcatggccgcgtccaccgcatcagcatctttgacaacctggatgtggtgtcagaggatgaggaagcccccgaggaggcccctgagaatggcagcaacaaggagaacactgagacaccagctgctactcccaagtcaggcaaacataagaacaaggagaagcgcaaggactccaaccatcaccaccaccacaatgtttctgcgagcaccactcccaagctgccagaggtggtctatcgggagctggaacaggacacccctgatgccccaccccggccaacttcctattaccggtacatcgagaagtctgcagaggagctggacgaggaagtagagtatgacatggacgaggaggactacatctggctggatatcatgaatgagcgtcggaagacagagggtgtaagtcccatcccgcaggagatctttgagtacctaatggaccgactggagaaggagtcgtactttgagagtcataataaaggcgaccctaatgcgctagtggacgaggatgctgtttgctgtatctgcaatgatggtgagtgccagaacagcaatgtcatcctcttctgtgacatgtgcaacctggaagtgcaccaggagtgctacggtgtcccctatatccctgagggccagtggctgtgccgccgttgcctgcagtcaccctctcgtgctgtggattgtgccctgtgccccaacaagggcggtgccttcaagcagacagatgacgggcgctgggcccatgtggtgtgtgccttgtggatccctgaggtctgcttcgccaacacggtcttcctagagcctattgacagcattgagcacatcccaccagctcgctggaagctcacctgctacatttgcaaacaacggggctcaggggcctgcatccagtgccacaaggccaactgttacacagctttccatgtgacatgcgcccagcaggctggcctttacatgaagatggagcctgtgcgggagacaggcgccaacggcacctctttcagtgtccgcaagacagcctactgcgacatccacacgcctccaggttcagcacgccgactgcctgccctgtcccacagcgagggtgaggaggatgaagatgaggaggaggatgagggtaagggctggagctcagagaaagtcaagaaggccaaggccaagtcccggatcaaaatgaagaaggcacggaagatcctggcagagaagcgggcagcagcacctgtggtgtcagtgccctgcatcccaccacacaggcttagtaaaatcaccaaccgcctgaccatccaaaggaagagccagttcatgcagaggctgcacagctactggacactgaagcggcagtcacggaatggggtcccattgctacgtcgcctgcagacacacctgcaatctcagaggaactgtgaccaagttgggagagattctgaggataagaactgggcccttaaagaacagctcaagtcctggcagcggctccggcatgacttggagcgagctcggctgctcgtggaattgatccgcaagcgggaaaaactcaaaagggagacgatcaaggttcagcagattgccatggagatgcagctgactcctttcctcatcctccttcgcaaaaccttggagcagctccaagagaaggacacaggcaacatcttcagcgagccggtccctctgtctgaggtacctgactacctagaccacatcaaaaagcccatggactttttcaccatgaagcagaacttggaggcttaccgctacctgaattttgatgattttgaggaggacttcaacctcatcgtcagcaactgcctcaagtataacgccaaggacaccatcttctaccgggcagcagtgcggcttcgtgagcagggtggtgctgtgctccgccaggcccggcgccaggcagaaaaaatgggcattgactttgagacgggcatgcatatcccccacagcctggctggagatgaggccacacaccacactgaagatgcagccgaggaagagcggctggtcttgctggagaaccagaagcacctgccagtggaagaacagctaaagctgcttctggagcggctggacgaagtgaatgccagcaagcagagtgtgggccgctcacggcgtgcaaagatgatcaagaaagagatgacggcactgcggcggaagcttgcccatcagcgagagacgggacgtgatggccctgagcggcatggcccctcgagccggggtagtctgacaccccacccggcagcctgtgacaaggatgggcagacagatagtgcggcagaggagagcagcagccaggagacaagcaaaggcctgggtcccaacatgtcctcaacccccgcacatgaggtgggcaggagaacctcagttctgttctccaaaaagaacccgaagacagctggaccgcccaagaggccgggccggccccccaaaaaccgggagagccagatgacccccagccacggaggcagtcctgtggggcccccccagctccccatcatgagttccctgcgtcagcgcaagcggggtaggagcccccggcccagttcgagctcagacagcgacagtgataagtccacagaagaccccccaatggacttaccagccaatggcttcagcggtggaaaccaaccagtgaagaagagtttcttggtataccgtaatgactgcagccttccccggagcagctcagactctgagtccagcagcagtagcagtagcagcgctgcttcagaccggaccagcacaacgccctcaaaacaaggccggggcaaaccctccttctctcggggcactttcccagaggacagcagtgaggatacctcaggcactgagaatgaggcctactccgtgggcactggccgcggcgtgggccacagcatggtaaggaagagtctgggccggggagctggctggctgtcagaggatgaggactccccgctggatgctctggacctcgtgtgggccaaatgccgaggctatccatcatacccagctctgatcattgatccaaagatgccccgagaaggtatgttccaccatggggttcccatccctgtgcccccactggaggtgctgaaacttggggagcagatgacccaggaagcccgagagcatctctacctcgtcctcttctttgacaacaaacgaacctggcagtggctgcccaggaccaagctggttcctctgggtgtgaaccaggacctagacaaggagaagatgctggagggccgcaagtccaacatccgcaagtcagtacagatcgcctaccacagggctctgcagcaccgcagcaaggtgcaaggcgagcagagcagtgagaccagcgatagtgattgatactgctcaacacagcccaacctatagtgccctgtgacttctctcctcccctttgctcactgtcctggagtggcaccggcctctgcactgactcatttctggtcttggggccagtctcaggggaagctgggtgggggaggtccctcctgccctaagtgcagctggactgtacagaacactccaagggccaatggcagttcagcgcaaggagagggagggcccacaggtcagaaaaagctccagagacctcacagcattgtagggcggggtggtgggccaaagttaggacactgcgtaaaacaggccatcccaccacctctacctgctcatgccaggagaatccataactgcctagaggcctggggcccctaccggtcgtgaggtgagtgggcatctgtccagcctggaagaggggcactaggtgactccctcccctgctgttgtaaatactgtaattatcggagaatttaaattattctcatttgtaactgcgtttccgggtcgcgccagagtcatttggtactaaaaaaaaaaaaaaaaaagactgggggctgtccccatttcccttctctttcccatagattcccccacctttcaaactggtttgtatttatttcaaaggaagaaaatatattgattcttagaaaataaactgtcaatttagaat

SEQ ID NO: 344002 - DNA, 4824 bp, Homo sapiens
tgcgcagacgccgtcgccgccgctgctgccgccgccgctgccacagcctttgccgccacggtctccgccgccgctgtcctcgcgctgcctctgggagcctccattgttccagcagcgcccggtcccgagaccgggcatcttgggggctcgcgaaacgggcggcggccgacggagttgagaccccagggcgccggcgggaccaggagcggcaggggtcagctcaggaatcccggggagccgggaccaaagcgtggggcggcagggggccggggtggcgaggtctacggtctccggagttggggctcccccttcccggcccgactttccccgccgacctccccaagtggggtcggagccccggcgggcgcccccggcgatgagcccggactcgaggtggccgatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggaggtggacttgcatggccgcgtccaccgcatcagcatctttgacaacctggatgtggtgtcagaggatgaggaagcccccgaggaggcccctgagaatggcagcaacaaggagaacactgagacaccagctgctactcccaagtcaggcaaacataagaacaaggagaagcgcaaggactccaaccatcaccaccaccacaatgtttctgcgagcaccactcccaagctgccagaggtggtctatcgggagctggaacaggacacccctgatgccccaccccggccaacttcctattaccggtacatcgagaagtctgcagaggagctggacgaggaagtagagtatgacatggacgaggaggactacatctggctggatatcatgaatgagcgtcggaagacagagggtgtaagtcccatcccgcaggagatctttgagtacctaatggaccgactggagaaggagtcgtactttgagagtcataataaaggcgaccctaatgcgctagtggacgaggatgctgtttgctgtatctgcaatgatggtgagtgccagaacagcaatgtcatcctcttctgtgacatgtgcaacctggaagtgcaccaggagtgctacggtgtcccctatatccctgagggccagtggctgtgccgccgttgcctgcagtcaccctctcgtgctgtggattgtgccctgtgccccaacaagggcggtgccttcaagcagacagatgacgggcgctgggcccatgtggtgtgtgccttgtggatccctgaggtctgcttcgccaacacggtcttcctagagcctattgacagcattgagcacatcccaccagctcgctggaagctcacctgctacatttgcaaacaacggggctcaggggcctgcatccagtgccacaaggccaactgttacacagctttccatgtgacatgcgcccagcaggctggcctttacatgaagatggagcctgtgcgggagacaggcgccaacggcacctctttcagtgtccgcaagacagcctactgcgacatccacacgcctccaggttcagcacgccgactgcctgccctgtcccacagcgagggtgaggaggatgaagatgaggaggaggatgagggtaagggctggagctcagagaaagtcaagaaggccaaggccaagtcccggatcaaaatgaagaaggcacggaagatcctggcagagaagcgggcagcagcacctgtggtgtcagtgccctgcatcccaccacacaggcttagtaaaatcaccaaccgcctgaccatccaaaggaagagccagttcatgcagaggctgcacagctactggacactgaagcggcagtcacggaatggggtcccattgctacgtcgcctgcagacacacctgcaatctcagaggaactgtgaccaagttgggagagattctgaggataagaactgggcccttaaagaacagctcaagtcctggcagcggctccggcatgacttggagcgagctcggctgctcgtggaattgatccgcaagcgggaaaaactcaaaagggagacgatcaaggttcagcagattgccatggagatgcagctgactcctttcctcatcctccttcgcaaaaccttggagcagctccaagagaaggacacaggcaacatcttcagcgagccggtccctctgtctgaggtacctgactacctagaccacatcaaaaagcccatggactttttcaccatgaagcagaacttggaggcttaccgctacctgaattttgatgattttgaggaggacttcaacctcatcgtcagcaactgcctcaagtataacgccaaggacaccatcttctaccgggcagcagtgcggcttcgtgagcagggtggtgctgtgctccgccaggcccggcgccaggcagaaaaaatgggcattgactttgagacgggcatgcatatcccccacagcctggctggagatgaggccacacaccacactgaagatgcagccgaggaagagcggctggtcttgctggagaaccagaagcacctgccagtggaagaacagctaaagctgcttctggagcggctggacgaagtgaatgccagcaagcagagtgtgggccgctcacggcgtgcaaagatgatcaagaaagagatgacggcactgcggcggaagcttgcccatcagcgagagacgggacgtgatggccctgagcggcatggcccctcgagccggggtagtctgacaccccacccggcagcctgtgacaaggatgggcagacagatagtgcggcagaggagagcagcagccaggagacaagcaaaggcctgggtcccaacatgtcctcaacccccgcacatgaggtgggcaggagaacctcagttctgttctccaaaaagaacccgaagacagctggaccgcccaagaggccgggccggccccccaaaaaccgggagagccagatgacccccagccacggaggcagtcctgtggggcccccccagctccccatcatgagttccctgcgtcagcgcaagcggggtaggagcccccggcccagttcgagctcagacagcgacagtgataagtccacagaagaccccccaatggacttaccagccaatggcttcagcggtggaaaccaaccagtgaagaagagtttcttggtataccgtaatgactgcagccttccccggagcagctcagactctgagtccagcagcagtagcagtagcagcgctgcttcagaccggaccagcacaacgccctcaaaacaaggccggggcaaaccctccttctctcggggcactttcccagaggacagcagtgaggatacctcaggcactgagaatgaggcctactccgtgggcactggccgcggcgtgggccacagcagtaagttcccttgcccaaggccagggatgctggggacccagtgtcagggtctcgccagccccccagctgctgatccaccccctctcccccattcctgtgaagtggtaaggaagagtctgggccggggagctggctggctgtcagaggatgaggactccccgctggatgctctggacctcgtgtgggccaaatgccgaggctatccatcatacccagctctgatcattgatccaaagatgccccgagaaggtatgttccaccatggggttcccatccctgtgcccccactggaggtgctgaaacttggggagcagatgacccaggaagcccgagagcatctctacctcgtcctcttctttgacaacaaacgaacctggcagtggctgcccaggaccaagctggttcctctgggtgtgaaccaggacctagacaaggagaagatgctggagggccgcaagtccaacatccgcaagtcagtacagatcgcctaccacagggctctgcagcaccgcagcaaggtgcaaggcgagcagagcagtgagaccagcgatagtgattgatactgctcaacacagcccaacctatagtgccctgtgacttctctcctcccctttgctcactgtcctggagtggcaccggcctctgcactgactcatttctggtcttggggccagtctcaggggaagctgggtgggggaggtccctcctgccctaagtgcagctggactgtacagaacactccaagggccaatggcagttcagcgcaaggagagggagggcccacaggtcagaaaaagctccagagacctcacagcattgtagggcggggtggtgggccaaagttaggacactgcgtaaaacaggccatcccaccacctctacctgctcatgccaggagaatccataactgcctagaggcctggggcccctaccggtcgtgaggtgagtgggcatctgtccagcctggaagaggggcactaggtgactccctcccctgctgttgtaaatactgtaattatcggagaatttaaattattctcatttgtaactgcgtttccgggtcgcgccagagtcatttggtactaaaaaaaaaaaaaaaaaagactgggggctgtccccatttcccttctctttcccatagattcccccacctttcaaactggtttgtatttatttcaaaggaagaaaatatattgattcttagaaaataaactgtcaatttagaat

SEQ ID NO: 344003 - DNA, 4940 bp, Homo sapiens
tgcgcagacgccgtcgccgccgctgctgccgccgccgctgccacagcctttgccgccacggtctccgccgccgctgtcctcgcgctgcctctgggagcctccattgttccagcagcgcccggtcccgagaccgggcatcttgggggctcgcgaaacgggcggcggccgacggagttgagaccccagggcgccggcgggaccaggagcggcaggggtcagctcaggaatcccggggagccgggaccaaagcgtggggcggcagggggccggggtggcgaggtctacggtctccggagttggggctcccccttcccggcccgactttccccgccgacctccccaagtggggtcggagccccggcgggcgcccccggcgatgagcccggactcgaggtggccgatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggaggtggacttgcatggccgcgtccaccgcatcagcatctttgacaacctggatgtggtgtcagaggatgaggaagcccccgaggaggcccctgagaatggcagcaacaaggagaacactgagacaccagctgctactcccaagtcaggcaaacataagaacaaggagaagcgcaaggactccaaccatcaccaccaccacaatgtttctgcgagcaccactcccaagctgccagaggtggtctatcgggagctggaacaggacacccctgatgccccaccccggccaacttcctattaccggtacatcgagaagtctgcagaggagctggacgaggaagtagagtatgacatggacgaggaggactacatctggctggatatcatgaatgagcgtcggaagacagagggtgtaagtcccatcccgcaggagatctttgagtacctaatggaccgactggagaaggagtcgtactttgagagtcataataaaggcgaccctaatgcgctagtggacgaggatgctgtttgctgtatctgcaatgatggtgagtgccagaacagcaatgtcatcctcttctgtgacatgtgcaacctggaagtgcaccaggagtgctacggtgtcccctatatccctgagggccagtggctgtgccgccgttgcctgcagtcaccctctcgtgctgtggattgtgccctgtgccccaacaagggcggtgccttcaagcagacagatgacgggcgctgggcccatgtggtgtgtgccttgtggatccctgaggtctgcttcgccaacacggtcttcctagagcctattgacagcattgagcacatcccaccagctcgctggaagctcacctgctacatttgcaaacaacggggctcaggggcctgcatccagtgccacaaggccaactgttacacagctttccatgtgacatgcgcccagcaggctggcctttacatgaagatggagcctgtgcgggagacaggcgccaacggcacctctttcagtgtccgcaagacagcctactgcgacatccacacgcctccaggttcagcacgccgactgcctgccctgtcccacagcgagggtgaggaggatgaagatgaggaggaggatgagggtaagggctggagctcagagaaagtcaagaaggccaaggccaagtcccggatcaaaatgaagaaggcacggaagatcctggcagagaagcgggcagcagcacctgtggtgtcagtgccctgcatcccaccacacaggcttagtaaaatcaccaaccgcctgaccatccaaaggaagagccagttcatgcagaggctgcacagctactggacactgaagcggcagtcacggaatggggtcccattgctacgtcgcctgcagacacacctgcaatctcagaggaactgtgaccaagttgggagagattctgaggataagaactgggcccttaaagaacagctcaagtcctggcagcggctccggcatgacttggagcgagctcggctgctcgtggaattgatccgcaagcgggaaaaactcaaaagggagacgatcaaggttcagcagattgccatggagatgcagctgactcctttcctcatcctccttcgcaaaaccttggagcagctccaagagaaggacacaggcaacatcttcagcgagccggtccctctgtctgaggtacctgactacctagaccacatcaaaaagcccatggactttttcaccatgaagcagaacttggaggcttaccgctacctgaattttgatgattttgaggaggacttcaacctcatcgtcagcaactgcctcaagtataacgccaaggacaccatcttctaccgggcagcagtgcggcttcgtgagcagggtggtgctgtgctccgccaggcccggcgccaggcagaaaaaatgggcattgactttgagacgggcatgcatatcccccacagcctggctggagatgaggccacacaccacactgaagatggtgggtgatatatcacacacacatataagaggccaatgccggggatggacagctttccaaaagtcccctcctgggagcaggcagtgtaggcagaaagcagctaggctgagcagtggcaagctatccccaggaatgctccccaagaagccagactgggtgaatggatagcagtgcccgccattccacatcttggtgctgctattttacagctgttcctgcagccgaggaagagcggctggtcttgctggagaaccagaagcacctgccagtggaagaacagctaaagctgcttctggagcggctggacgaagtgaatgccagcaagcagagtgtgggccgctcacggcgtgcaaagatgatcaagaaagagatgacggcactgcggcggaagcttgcccatcagcgagagacgggacgtgatggccctgagcggcatggcccctcgagccggggtagtctgacaccccacccggcagcctgtgacaaggatgggcagacagatagtgcggcagaggagagcagcagccaggagacaagcaaaggcctgggtcccaacatgtcctcaacccccgcacatgaggtgggcaggagaacctcagttctgttctccaaaaagaacccgaagacagctggaccgcccaagaggccgggccggccccccaaaaaccgggagagccagatgacccccagccacggaggcagtcctgtggggcccccccagctccccatcatgagttccctgcgtcagcgcaagcggggtaggagcccccggcccagttcgagctcagacagcgacagtgataagtccacagaagaccccccaatggacttaccagccaatggcttcagcggtggaaaccaaccagtgaagaagagtttcttggtataccgtaatgactgcagccttccccggagcagctcagactctgagtccagcagcagtagcagtagcagcgctgcttcagaccggaccagcacaacgccctcaaaacaaggccggggcaaaccctccttctctcggggcactttcccagaggacagcagtgaggatacctcaggcactgagaatgaggcctactccgtgggcactggccgcggcgtgggccacagcatggtaaggaagagtctgggccggggagctggctggctgtcagaggatgaggactccccgctggatgctctggacctcgtgtgggccaaatgccgaggctatccatcatacccagctctgatcattgatccaaagatgccccgagaaggtatgttccaccatggggttcccatccctgtgcccccactggaggtgctgaaacttggggagcagatgacccaggaagcccgagagcatctctacctcgtcctcttctttgacaacaaacgaacctggcagtggctgcccaggaccaagctggttcctctgggtgtgaaccaggacctagacaaggagaagatgctggagggccgcaagtccaacatccgcaagtcagtacagatcgcctaccacagggctctgcagcaccgcagcaaggtgcaaggcgagcagagcagtgagaccagcgatagtgattgatactgctcaacacagcccaacctatagtgccctgtgacttctctcctcccctttgctcactgtcctggagtggcaccggcctctgcactgactcatttctggtcttggggccagtctcaggggaagctgggtgggggaggtccctcctgccctaagtgcagctggactgtacagaacactccaagggccaatggcagttcagcgcaaggagagggagggcccacaggtcagaaaaagctccagagacctcacagcattgtagggcggggtggtgggccaaagttaggacactgcgtaaaacaggccatcccaccacctctacctgctcatgccaggagaatccataactgcctagaggcctggggcccctaccggtcgtgaggtgagtgggcatctgtccagcctggaagaggggcactaggtgactccctcccctgctgttgtaaatactgtaattatcggagaatttaaattattctcatttgtaactgcgtttccgggtcgcgccagagtcatttggtactaaaaaaaaaaaaaaaaaagactgggggctgtccccatttcccttctctttcccatagattcccccacctttcaaactggtttgtatttatttcaaaggaagaaaatatattgattcttagaaaataaactgtcaatttagaat

SEQ ID NO: 344004 - DNA, 3746 bp, Homo sapiens
tgcgcagacgccgtcgccgccgctgctgccgccgccgctgccacagcctttgccgccacggtctccgccgccgctgtcctcgcgctgcctctgggagcctccattgttccagcagcgcccggtcccgagaccgggcatcttgggggctcgcgaaacgggcggcggccgacggagttgagaccccagggcgccggcgggaccaggagcggcaggggtcagctcaggaatcccggggagccgggaccaaagcgtggggcggcagggggccggggtggcgaggtctacggtctccggagttggggctcccccttcccggcccgactttccccgccgacctccccaagtggggtcggagccccggcgggcgcccccggcgatgagcccggactcgaggtggccgatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggaggtggacttgcatggccgcgtccaccgcatcagcatctttgacaacctggatgtggtgtcagaggatgaggaagcccccgaggaggcccctgagaatggcagcaacaaggagaacactgagacaccagctgctactcccaagtcaggcaaacataagaacaaggagaagcgcaaggactccaaccatcaccaccaccacaatgtttctgcgagcaccactcccaagctgccagaggtggtctatcgggagctggaacaggacacccctgatgccccaccccggccaacttcctattaccggtacatcgagaagtctgcagaggagctggacgaggaagtagagtatgacatggacgaggaggactacatctggctggatatcatgaatgagcgtcggaagacagagggtgtaagtcccatcccgcaggagatctttgagtacctaatggaccgactggagaaggagtcgtactttgagagtcataataaaggcgaccctaatgcgctagtggacgaggatgctgtttgctgtatctgcaatgatggtgagtgccagaacagcaatgtcatcctcttctgtgacatgtgcaacctggaagtgcaccaggagtgctacggtgtcccctatatccctgagggccagtggctgtgccgccgttgcctgcagtcaccctctcgtgctgtggattgtgccctgtgccccaacaagggcggtgccttcaagcagacagatgacgggcgctgggcccatgtggtgtgtgccttgtggatccctgaggtctgcttcgccaacacggtcttcctagagcctattgacagcattgagcacatcccaccagctcgctggaagctcacctgctacatttgcaaacaacggggctcaggggcctgcatccagtgccacaaggccaactgttacacagctttccatgtgacatgcgcccagcaggctggcctttacatgaagatggagcctgtgcgggagacaggcgccaacggcacctctttcagtgtccgcaagacagcctactgcgacatccacacgcctccaggttcagcacgccgactgcctgccctgtcccacagcgagggtgaggaggatgaagatgaggaggaggatgagggtaagggctggagctcagagaaagtcaagaaggccaaggccaagtcccggatcaaaatgaagaaggcacggaagatcctggcagagaagcgggcagcagcacctgtggtgtcagtgccctgcatcccaccacacaggcttagtaaaatcaccaaccgcctgaccatccaaaggaagagccagttcatgcagaggctgcacagctactggacactgaagcggcagtcacggaatggggtcccattgctacgtcgcctgcagacacacctgcaatctcagaggaactgtgaccaagttgggagagattctgaggataagaactgggcccttaaagaacagctcaagtcctggcagcggctccggcatgacttggagcgagctcggctgctcgtggaattgatccgcaagcgggaaaaactcaaaagggagacgatcaaggttcagcagattgccatggagatgcagctgactcctttcctcatcctccttcgcaaaaccttggagcagctccaagagaaggacacaggcaacatcttcagcgagccggtccctctgtctgaggtacctgactacctagaccacatcaaaaagcccatggactttttcaccatgaagcagaacttggaggcttaccgctacctgaattttgatgattttgaggaggacttcaacctcatcgtcagcaactgcctcaagtataacgccaaggacaccatcttctaccgggcagcagtgcggcttcgtgagcagggtggtgctgtgctccgccaggcccggcgccaggcagaaaaaatgggcattgactttgagacgggcatgcatatcccccacagcctggctggagatgaggccacacaccacactgaagatgcagccgaggaagagcggctggtcttgctggagaaccagaagcacctgccagtggaagaacagctaaagctgcttctggagcggctggacgaagtgaatgccagcaagcagagtgtgggccgctcacggcgtgcaaagatgatcaagaaagagatgacggcactgcggcggaagcttgcccatcagcgagagacgggacgtgatggccctgagcggcatggcccctcgagccggggtagtctgacaccccacccggcagcctgtgacaaggatgggcagacagatagtgcggcagaggagagcagcagccaggagacaagcaaaggcctgggtcccaacatgtcctcaacccccgcacatgaggtgggcaggagaacctcagttctgttctccaaaaagaacccgaagacagctggaccgcccaagaggccgggccggccccccaaaaaccgggagagccagatgacccccagccacggaggcagtcctgtggggcccccccagctccccatcatgagttccctggccctaagtgcagctggactgtacagaacactccaagggccaatggcagttcagcgcaaggagagggagggcccacaggtcagaaaaagctccagagacctcacagcattgtagggcggggtggtgggccaaagttaggacactgcgtaaaacaggccatcccaccacctctacctgctcatgccaggagaatccataactgcctagaggcctggggcccctaccggtcgtgaggtgagtgggcatctgtccagcctggaagaggggcactaggtgactccctcccctgctgttgtaaatactgtaattatcggagaatttaaattattctcatttgtaactgcgtttccgggtcgcgccagagtcatttggtactaaaaaaaaaaaaaaaaaagactgggggctgtccccatttcccttctctttcccatagattcccccacctttcaaactggtttgtatttatttcaaaggaagaaaatatattgattcttagaaaataaactgtcaatttagaat

SEQ ID NO: 344005 - DNA, 323 bp, Homo sapiens
ctttaagccatttgtgtcctaaagccagtaactgccgagggaagcaaggggtggagcagggctgtggccaactgtggtagacactgcccagagctagctctgctggccaaggttggaggaattttccagcacagaaggggaacccaagctccaagtccctcttacctccatgtcatctctgatctacatcttcctgaccggttccttccctcctccccttcccttcaaccaagacttaccagccaatggcttcagcggtggaaaccaaccagtgaagaagagtttcttggtataccgtaatgactgcagccttccccggagca

SEQ ID NO: 344006 - DNA, 417 bp, Homo sapiens
ttcaaaggctcagtctcagtggggctcccagggtcaaatagtactctgggctgcagtgactagagcagtcttaggggcagaagtccctgattgctggtgtacagggttagggatctggtttagtgctgggagcttggtttcctgtctgccacggtaccactgatggcaccactctttcttccttgccttaagtccagagtcccaggccttttggacaagagatcctctcccttcatccccattcaggaactttcactggccagagacccttgctctgcttaagagaatcagggcccaacaagttttactctttgtttcctgcctcccaggcttagtaaaatcaccaaccgcctgaccatccaaaggaagagccagttcatgcagaggctgcacagctactggacactgaagcggcag

SEQ ID NO: 344007 - DNA, 341 bp, Homo sapiens
aacaaacacataccaagcatttattctgccaggccttggggacacacagattgaggcactaccaataaattactgtgctccctcttttggcttgacctgagtttcctgggctctcttctccctgttgacctttcctctggctttctaatcatcctctgatcttcgttttgcctctacagagagattctgaggataagaactgggcccttaaagaacagctcaagtcctggcagcggctccggcatgacttggagcgagctcggctgctcgtggaattgatccgcaagcgggaaaaactcaaaagggagacggtgagtgctcctgggccagccctattttat

SEQ ID NO: 344008 - DNA, 289 bp, Homo sapiens
atcattgatccaaagatgccccgagaaggtatgttccaccatggggttcccatccctgtgcccccactggaggtgctgaaacttggggagcagatgacccaggaagcccgagagcatctctacctcgtcctcttctttgacaacaaacgaacctggtaaggaggggagcatttggtgtgactcacagccacagatgcagccctgtgtggtatgggggcagactgccaggaaactccagcaacaggcagactgggctatcacaagtcagtgggggagggacttagaacag

SEQ ID NO: 344009 - DNA, 4740 bp, Homo sapiens
tgcgcagacgccgtcgccgccgctgctgccgccgccgctgccacagcctttgccgccacggtctccgccgccgctgtcctcgcgctgcctctgggagcctccattgttccagcagcgcccggtcccgagaccgggcatcttgggggctcgcgaaacgggcggcggccgacggagttgagaccccagggcgccggcgggaccaggagcggcaggggtcagctcaggaatcccggggagccgggaccaaagcgtggggcggcagggggccggggtggcgaggtctacggtctccggagttggggctcccccttcccggcccgactttccccgccgacctccccaagtggggtcggagccccggcgggcgcccccggcgatgagcccggactcgaggtggccgatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggaggtggacttgcatggccgcgtccaccgcatcagcatctttgacaacctggatgtggtgtcagaggatgaggaagcccccgaggaggcccctgagaatggcagcaacaaggagaacactgagacaccagctgctactcccaagtcaggcaaacataagaacaaggagaagcgcaaggactccaaccatcaccaccaccacaatgtttctgcgagcaccactcccaagctgccagaggtggtctatcgggagctggaacaggacacccctgatgccccaccccggccaacttcctattaccggtacatcgagaagtctgcagaggagctggacgaggaagtagagtatgacatggacgaggaggactacatctggctggatatcatgaatgagcgtcggaagacagagggtgtaagtcccatcccgcaggagatctttgagtacctaatggaccgactggagaaggagtcgtactttgagagtcataataaaggcgaccctaatgcgctagtggacgaggatgctgtttgctgtatctgcaatgatggtgagtgccagaacagcaatgtcatcctcttctgtgacatgtgcaacctggaagtgcaccaggagtgctacggtgtcccctatatccctgagggccagtggctgtgccgccgttgcctgcagtcaccctctcgtgctgtggattgtgccctgtgccccaacaagggcggtgccttcaagcagacagatgacgggcgctgggcccatgtggtgtgtgccttgtggatccctgaggtctgcttcgccaacacggtcttcctagagcctattgacagcattgagcacatcccaccagctcgctggaagctcacctgctacatttgcaaacaacggggctcaggggcctgcatccagtgccacaaggccaactgttacacagctttccatgtgacatgcgcccagcaggctggcctttacatgaagatggagcctgtgcgggagacaggcgccaacggcacctctttcagtgtccgcaagacagcctactgcgacatccacacgcctccaggttcagcacgccgactgcctgccctgtcccacagcgagggtgaggaggatgaagatgaggaggaggatgagggtaagggctggagctcagagaaagtcaagaaggccaaggccaagtcccggatcaaaatgaagaaggcacggaagatcctggcagagaagcgggcagcagcacctgtggtgtcagtgccctgcatcccaccacacaggcttagtaaaatcaccaaccgcctgaccatccaaaggaagagccagttcatgcagaggctgcacagctactggacactgaagcggcagtcacggaatggggtcccattgctacgtcgcctgcagacacacctgcaatctcagaggaactgtgaccaagttgggagagattctgaggataagaactgggcccttaaagaacagctcaagtcctggcagcggctccggcatgacttggagcgagctcggctgctcgtggaattgatccgcaagcgggaaaaactcaaaagggagacgatcaaggttcagcagattgccatggagatgcagctgactcctttcctcatcctccttcgcaaaaccttggagcagctccaagagaaggacacaggcaacatcttcagcgagccggtccctctgtctgaggtaaccgaattggacgaagtacctgactacctagaccacatcaaaaagcccatggactttttcaccatgaagcagaacttggaggcttaccgctacctgaattttgatgattttgaggaggacttcaacctcatcgtcagcaactgcctcaagtataacgccaaggacaccatcttctaccgggcagcagtgcggcttcgtgagcagggtggtgctgtgctccgccaggcccggcgccaggcagaaaaaatgggcattgactttgagacgggcatgcatatcccccacagcctggctggagatgaggccacacaccacactgaagatgcagccgaggaagagcggctggtcttgctggagaaccagaagcacctgccagtggaagaacagctaaagctgcttctggagcggctggacgaagtgaatgccagcaagcagagtgtgggccgctcacggcgtgcaaagatgatcaagaaagagatgacggcactgcggcggaagcttgcccatcagcgagagacgggacgtgatggccctgagcggcatggcccctcgagccggggtagtctgacaccccacccggcagcctgtgacaaggatgggcagacagatagtgcggcagaggagagcagcagccaggagacaagcaaaggcctgggtcccaacatgtcctcaacccccgcacatgaggtgggcaggagaacctcagttctgttctccaaaaagaacccgaagacagctggaccgcccaagaggccgggccggccccccaaaaaccgggagagccagatgacccccagccacggaggcagtcctgtggggcccccccagctccccatcatgagttccctgcgtcagcgcaagcggggtaggagcccccggcccagttcgagctcagacagcgacagtgataagtccacagaagaccccccaatggacttaccagccaatggcttcagcggtggaaaccaaccagtgaagaagagtttcttggtataccgtaatgactgcagccttccccggagcagctcagactctgagtccagcagcagtagcagtagcagcgctgcttcagaccggaccagcacaacgccctcaaaacaaggccggggcaaaccctccttctctcggggcactttcccagaggacagcagtgaggatacctcaggcactgagaatgaggcctactccgtgggcactggccgcggcgtgggccacagcatggtaaggaagagtctgggccggggagctggctggctgtcagaggatgaggactccccgctggatgctctggacctcgtgtgggccaaatgccgaggctatccatcatacccagctctgatcattgatccaaagatgccccgagaaggtatgttccaccatggggttcccatccctgtgcccccactggaggtgctgaaacttggggagcagatgacccaggaagcccgagagcatctctacctcgtcctcttctttgacaacaaacgaacctggcagtggctgcccaggaccaagctggttcctctgggtgtgaaccaggacctagacaaggagaagatgctggagggccgcaagtccaacatccgcaagtcagtacagatcgcctaccacagggctctgcagcaccgcagcaaggtgcaaggcgagcagagcagtgagaccagcgatagtgattgatactgctcaacacagcccaacctatagtgccctgtgacttctctcctcccctttgctcactgtcctggagtggcaccggcctctgcactgactcatttctggtcttggggccagtctcaggggaagctgggtgggggaggtccctcctgccctaagtgcagctggactgtacagaacactccaagggccaatggcagttcagcgcaaggagagggagggcccacaggtcagaaaaagctccagagacctcacagcattgtagggcggggtggtgggccaaagttaggacactgcgtaaaacaggccatcccaccacctctacctgctcatgccaggagaatccataactgcctagaggcctggggcccctaccggtcgtgaggtgagtgggcatctgtccagcctggaagaggggcactaggtgactccctcccctgctgttgtaaatactgtaattatcggagaatttaaattattctcatttgtaactgcgtttccgggtcgcgccagagtcatttggtactaaaaaaaaaaaaaaaaaagactgggggctgtccccatttcccttctctttcccatagattcccccacctttcaaactggtttgtatttatttcaaaggaagaaaatatattgattcttagaaaataaactgtcaatttagaat

SEQ ID NO: 344010 - DNA, 4437 bp, Homo sapiens
tgcgcagacgccgtcgccgccgctgctgccgccgccgctgccacagcctttgccgccacggtctccgccgccgctgtcctcgcgctgcctctgggagcctccattgttccagcagcgcccggtcccgagaccgggcatcttgggggctcgcgaaacgggcggcggccgacggagttgagaccccagggcgccggcgggaccaggagcggcaggggtcagctcaggaatcccggggagccgggaccaaagcgtggggcggcagggggccggggtggcgaggtctacggtctccggagttggggctcccccttcccggcccgactttccccgccgacctccccaagtggggtcggagccccggcgggcgcccccggcgatgagcccggactcgaggtggccgatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggaggtggacttgcatggccgcgtccaccgcatcagcatctttgacaacctggatgtggtgtcagaggatgaggaagcccccgaggaggcccctgagaatggcagcaacaaggagaacactgagacaccagctgctactcccaagtcaggcaaacataagaacaaggagaagcgcaaggactccaaccatcaccaccaccacaatgtttctgcgagcaccactcccaagctgccagaggtggtctatcgggagctggaacaggacacccctgatgccccaccccggccaacttcctattaccggtacatcgagaagtctgcagaggagctggacgaggaagtagagtatgacatggacgaggaggactacatctggctggatatcatgaatgagcgtcggaagacagagggtgtaagtcccatcccgcaggagatctttgagtacctaatggaccgactggagaaggagtcgtactttgagagtcataataaaggcgaccctaatgcgctagtggacgaggatgctgtttgctgtatctgcaatgatggtgagtgccagaacagcaatgtcatcctcttctgtgacatgtgcaacctggaagtgcaccaggagtgctacggtgtcccctatatccctgagggccagtggctgtgccgccgttgcctgcagtcaccctctcgtgctgtggattgtgccctgtgccccaacaagggcggtgccttcaagcagacagatgacgggcgctgggcccatgtggtgtgtgccttgtggatccctgaggtctgcttcgccaacacggtcttcctagagcctattgacagcattgagcacatcccaccagctcgctggaagctcacctgctacatttgcaaacaacggggctcaggggcctgcatccagtgccacaaggccaactgttacacagctttccatgtgacatgcgcccagcaggctggcctttacatgaagatggagcctgtgcgggagacaggcgccaacggcacctctttcagtgtccgcaagacagcctactgcgacatccacacgcctccaggttcagcacgccgactgcctgccctgtcccacagcgagggtgaggaggatgaagatgaggaggaggatgagggtaagggctggagctcagagaaagtcaagaaggccaaggccaagtcccggatcaaaatgaagaaggcacggaagatcctggcagagaagcgggcagcagcacctgtggtgtcagtgccctgcatcccaccacacaggcttagtaaaatcaccaaccgcctgaccatccaaaggaagagccagttcatgcagaggctgcacagctactggacactgaagcggcagtcacggaatggggtcccattgctacgtcgcctgcagacacacctgcaatctcagaggaactgtgaccaagttgggagagattctgaggataagaactgggcccttaaagaacagctcaagtcctggcagcggctccggcatgacttggagcgagctcggctgctcgtggaattgatccgcaagcgggaaaaactcaaaagggagacgatcaaggttcagcagattgccatggagatgcagctgactcctttcctcatcctccttcgcaaaaccttggagcagctccaagagaaggacacaggcaacatcttcagcgagccggtccctctgtctgaggtacctgactacctagaccacatcaaaaagcccatggactttttcaccatgaagcagaacttggaggcttaccgctacctgaattttgatgattttgaggaggacttcaacctcatcgtcagcaactgcctcaagtataacgccaaggacaccatcttctaccgggcagcagtgcggcttcgtgagcagggtggtgctgtgctccgccaggcccggcgccaggcagaaaaaatgggcattgactttgagacgggcatgcatatcccccacagcctggctggagatgaggccacacaccacactgaagatgcagccgaggaagagcggctggtcttgctggagaaccagaagcacctgccagtggaagaacagctaaagctgcttctggagcggctggacgaagtgaatgccagcaagcagagtgtgggccgctcacggcgtgcaaagatgatcaagaaagagatgacggcactgcggcggaagcttgcccatcagcgagagacgggacgtgatggccctgagcggcatggcccctcgagccggggtagtctgacaccccacccggcagcctgtgacaaggatgggcagacagatagtgcggcagaggagagcagcagccaggagacaagcaaagacttaccagccaatggcttcagcggtggaaaccaaccagtgaagaagagtttcttggtataccgtaatgactgcagccttccccggagcagctcagactctgagtccagcagcagtagcagtagcagcgctgcttcagaccggaccagcacaacgccctcaaaacaaggccggggcaaaccctccttctctcggggcactttcccagaggacagcagtgaggatacctcaggcactgagaatgaggcctactccgtgggcactggccgcggcgtgggccacagcatggtaaggaagagtctgggccggggagctggctggctgtcagaggatgaggactccccgctggatgctctggacctcgtgtgggccaaatgccgaggctatccatcatacccagctctgatcattgatccaaagatgccccgagaaggtatgttccaccatggggttcccatccctgtgcccccactggaggtgctgaaacttggggagcagatgacccaggaagcccgagagcatctctacctcgtcctcttctttgacaacaaacgaacctggcagtggctgcccaggaccaagctggttcctctgggtgtgaaccaggacctagacaaggagaagatgctggagggccgcaagtccaacatccgcaagtcagtacagatcgcctaccacagggctctgcagcaccgcagcaaggtgcaaggcgagcagagcagtgagaccagcgatagtgattgatactgctcaacacagcccaacctatagtgccctgtgacttctctcctcccctttgctcactgtcctggagtggcaccggcctctgcactgactcatttctggtcttggggccagtctcaggggaagctgggtgggggaggtccctcctgccctaagtgcagctggactgtacagaacactccaagggccaatggcagttcagcgcaaggagagggagggcccacaggtcagaaaaagctccagagacctcacagcattgtagggcggggtggtgggccaaagttaggacactgcgtaaaacaggccatcccaccacctctacctgctcatgccaggagaatccataactgcctagaggcctggggcccctaccggtcgtgaggtgagtgggcatctgtccagcctggaagaggggcactaggtgactccctcccctgctgttgtaaatactgtaattatcggagaatttaaattattctcatttgtaactgcgtttccgggtcgcgccagagtcatttggtactaaaaaaaaaaaaaaaaaagactgggggctgtccccatttcccttctctttcccatagattcccccacctttcaaactggtttgtatttatttcaaaggaagaaaatatattgattcttagaaaataaactgtcaatttagaat

SEQ ID NO: 344011 - DNA, 285 bp, Homo sapiens
gccactggaggtttggagcaggggagtggtgaaatgggattttaagagttgtaacagaaacaccagctgctgtgatgagaacggaatttaggggaacaagagtaggagctggaagaccagggaatccaggcagggatagtgagggaggtgttgagaagggatcgcattccacatgtattctgaaggtggccccgatgggatttactgatggagtggatgtggggtgtgagggaaagagagtcaaagatgactcctggctgggcgcagtggctcacatctgtaatc

SEQ ID NO: 344012 - DNA, 435 bp, Homo sapiens
agagtaggagctggaagaccagggaatccaggcagggatagtgagggaggtgttgagaagggatcgcattccacatgtattctgaaggtggccccgatgggatttactgatggagtggatgtggggtgtgagggaaagagagtcaaagatgactcctggctgggcgcagtggctcacatctgtaatcccagcactttgggaggccagggcaggtggatcacgaggtcaggagttcaagaccagcctggccaacttggtgaaaccccatctctattaaaaataaaaaattagccaggcatggtggcatgtgcctgtagtcccagcctctcgggaggctgaggcaggagaatcacttgaacccaggaggcagaggttgcagtgagccaagattgcgccactgcaccccagcctgggcaacagagcaagactctatct

SEQ ID NO: 344013 - DNA, 202 bp, Homo sapiens
tatatagagagagagagcacggatttttaaatcccaggggattctaatgtgcagccagggtttaggtaaaggaaagacccataatgcctatgtcccgcatcagtgagttttgataagtgaatcctagacatcataaagaagcaaaatgtccaagcattatgtcaacatcaagaagactaggatggtgggagaagtctaacaa

SEQ ID NO: 344014 - DNA, 395 bp, Homo sapiens
aggccaagaaattttgaccgagattacaaactagtggcaagaccaagtttcaaactcaagttgtctgactccaaaagtccctcttctttccactgtctgtcatcaatccttttaacctgggttagtgcagaaggacctgatgataaagaacaaattctcacctgatgcaaaacctctcaacatctgctcattttttcagttcatttttcacttccttccctgtcctgaacctggccctaaattacttataattcaccaataacacattgctgtgaacttttgcaagcactgtttgccttttctggaacattattctattgtctgtctgggcaatccagacttatctttcagcgcaagcatcattttctccagaaagcctttgctgtaccatcccc

SEQ ID NO: 344015 - DNA, 97 bp, Homo sapiens
ttggcttttccccccacctcctgtgcatgaaccggagaatgatggaacaattggttgtgtttggggcctttatttgcttttttccctcctctcttta

SEQ ID NO: 344016 - DNA, 572 bp, Homo sapiens
aaattttttcaacttgataaagaataaccaccaaagacaataaatatcattccttgtgttgaaacatcagatgcatcacctttaaaatcacaaatagtataaccaccactatttaaccacttctatttaactttctggaggacctagacaaagcacaaatataagaaatacaaataaaaatttttagaattgaaaaatgaaagtcacaactattatttttcacagatgatactacttacaaagaaaattcccaaaaagcctatagacaaattatagaaacagggggtttagcagaaacactctatttctgatcaacttgtagtaatcaatgcatatctatacaatagcaactaacaaaacacattttttaatttatgcattccttcaaatttacatatttatgggataattactatttgccaggcatttttctggcactgagaatatagcagtgaatacaattaataaatattcctgctttcatgggacttacattctagtgggaagtgatacaatgagttaataagtacaacatagcatatgagagatatgtaagataggcaaaaagaaaa

SEQ ID NO: 344017 - DNA, 496 bp, Homo sapiens
ataacacatgatgaatacattagttttattccaggaatgaaagagaatgtttacattttaaaatccatggcaacatttaccacattaaaatattaatggagaaaacagtctcagaagcagaaaatacaatacttattcatgataaaataaaatcttaaaacttaaacatgataaaattaccaatcacttatggtcaaaaaaattaatatactcatggtaaaacacaaactttaaatatcaaaggaaaacaaattttttcaacttgataaagaataaccaccaaagacaataaatatcattccttgtgttgaaacatcagatgcatcacctttaaaatcacaaatagtataaccaccactatttaaccacttctatttaactttctggaggacctagacaaagcacaaatataagaaatacaaataaaaatttttagaattgaaaaatgaaagtcacaactattatttttcacagatgatactacttacaaagaaaa

SEQ ID NO: 344018 - DNA, 270 bp, Homo sapiens
aggcataagccactgcacccagcctttctttgctcattcttacatctgtgtcagttcttggtcagtttgatttattgattattgtcctcattatagtttgtgtttttgccacctctatgcatgcttgataatccctgatgattgaatgccatatgtgaattttactttgtcaggtgtttaatatgtttgtatttttataaatatgtgctctggaatccaatttacttggaaatagtttgatctttctggggtcttgcttttattatttgt

SEQ ID NO: 344019 - DNA, 120 bp, Homo sapiens
catcatcaacatcaccaccagcagcaacagctgcagccgccaccaccgccaatacctgcaaatgggcaacaggccagcagccaaaatgaaggctttgactatttggcctgaagaatttta

SEQ ID NO: 344020 - DNA, 716 bp, Homo sapiens
ggtgggtggaagagagagagaaaaaaaacagtagtagtaaaaaaggaatcattacaggtaccacagacatcaaaagatattacgaacaacatttccaataaatctgacaacttaaataaaagtcacgtattctttattaaagaaatataatcttggctcacgcctgtaatcccagcactttgggaggccaaggcgggcagatcacaagatcaggagttcgaaaccagcctggccaataaggtgaaaccccgtctctactaaaaatacaaaaattagctgggtgtggtggcgcgtgcctatattcccagatactagggaggctgaggcagaagaatcgcttgaacccaggaggtggaggctgcagtgagccaagatcgtgccgctgcactccagcctgggcgagagagcaagactcagtctcaaaaaaagaaatataatctataaattacaaaccttctcacaaaggaaacttcagtcccagatggctttactaataaaatttgtatcttaaatttatataaacttttccagagaacagggaaaacaggaaacctttcctactttgttgtatgagtctagcataaccttattactaaaacttgacatgacaattacaagaaaaattatagaccaatctctcataaacataatgcaaaaatcctaaacatactagcaaatcaaatccaacaatatgtaaaacacgtatcacgaaaaaa

SEQ ID NO: 344021 - DNA, 1930 bp, Homo sapiens
agcggaacactggggactacatttcaacatgagatttggaggggacaaacatccaaaccatatctgatggcgacacaagatgtacagagagcagatgaaccttacctccctggaccccccactgcagctccgactcgaggccagctgggtccagttccacctgggtattaaccgccatgggctctactcccggtccagccctgttgtcagcaaacttctgcaagacatgaggcactttcccaccatcagtgctgattacagtcaagatgagaaagccttgctgggggcatgtgactgcacccagattgtgaaacccagtggggtccacctcaagctggtgctgaggttctcggatttcgggaaggccatgttcaaacccatgagcagcgagatgaggagacaccagtggacttcttctacttcattgactttcagagacacaatgctgagatcgcagctttccatctggacaggattctggacttccgacgggtgccgccaacagtggggaggatagtaaatgtcaccaaggaaatcctagaggtcaccaagaatgaaatcctgcagagtgttttctttgtctctccagcgagcaacgtgtgcttcttcgccaagtgtccatacatgtgcaagacggagtatgctgtctgtggcaacccacacctgctggagggttccctctctgccttcctgccgtccctcaacctggcccccaggctgtctgtgcccaacccctggatccgctcctacacactggcaggaaaagaggagtgggaggtcaatcccctttactgtgacacagtgaaacagatctacccgtacaacaacagccagcggctcctcaatgtcatcgacatggccatcttcgacttcttgatagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagtcggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaataaaaggacatcaagtggatacctgacttctcaggatccttatttctagcctgggtgacagagtgagaccatcttagatagacagatcgataaatagacaaatagacagataaaaacgtacctttggggacaaattaaatggttatctagccattgcttcttgatgttgtcttagcccatctaaacatatactgccagggcctaacataagtacaaaaggttcagctattatttgtggttagagataaagtagtatgaagaaaactgacatgctacttcaatttttaaatgtcaatatttaaatcatt

SEQ ID NO: 344022 - DNA, 2016 bp, Homo sapiens
agcggaacactggggactacatttcaacatgagatttggaggggacaaacatccaaaccatatctgatggcgacacaagatgtacagagagcagatgaaccttacctccctggaccccccactgcagctccgactcgaggccagctgggtccagttccacctgggtattaaccgccatgggctctactcccggtccagccctgttgtcagcaaacttctgcaagacatgaggcactttcccaccatcagtgctgattacagtcaagatgagaaagccttgctgggggcatgtgactgcacccagattgtgaaacccagtggggtccacctcaagctggtgctgaggttctcggatttcgggaaggccatgttcaaacccatgagcagcgagatgaggagacaccagtggacttcttctacttcattgactttcagagacacaatgctgagatcgcagctttccatctggacaggattctggacttccgacgggtgccgccaacagtggggaggatagtaaatgtcaccaaggaaatcctagaggtcaccaagaatgaaatcctgcagagtgttttctttgtctctccagcgagcaacgtgtgcttcttcgccaagtgtccatacatgtgcaagacggagtatgctgtctgtggcaacccacacctgctggagggttccctctctgccttcctgccgtccctcaacctggcccccaggctgtctgtgcccaacccctggatccgctcctacacactggcaggaaaagaggagtgggaggtcaatcccctttactgtgacacagtgaaacagatctacccgtacaacaacagccagcggctcctcaatgtcatcgacatggccatcttcgacttcttgatagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagtcggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaataaaaggacatcaagtggatacctgacttctcaggatccttattctagctacaagtcaaagataactcctggtccagacaaaacacctggcctatcacaagctgactaaaaatctgcactttgggccagcgcaggcaacagtaactctgacaggttcaaattagacctcacactttctactcatattctagtcactggacccatctgaatcagtaatccctactgcccggtcctggagtaacttcttagagatattataacaagtggcaaaaataaaagagggatttgctaagaatatcagaaaaggagtgttccaatttgaagagtattacaattgaaataacatcaaatatgtcacactaagcagccagtaacagaataaataattacaacg

SEQ ID NO: 344023 - DNA, 1676 bp, Homo sapiens
agcggaacactggggactacatttcaacatgagatttggaggggacaaacatccaaaccatatctgatggcgacacaagatgtacagagagcagatgaaccttacctccctggaccccccactgcagctccgactcgaggccagctgggtccagttccacctgggtattaaccgccatgggctctactcccggtccagccctgttgtcagcaaacttctgcaagacatgaggcactttcccaccatcagtgctgattacagtcaagatgagaaagccttgctgggggcatgtgactgcacccagattgtgaaacccagtggggtccacctcaagctggtgctgaggttctcggatttcgggaaggccatgttcaaacccatgagcagcgagatgaggagacaccagtggacttcttctacttcattgactttcagagacacaatgctgagatcgcagctttccatctggacaggattctggacttccgacgggtgccgccaacagtggggaggatagtaaatgtcaccaaggaaatcctagaggtcaccaagaatgaaatcctgcagagtgttttctttgtctctccagcgagcaacgtgtgcttcttcgccaagtgtccatacatgtgcaagacggagtatgctgtctgtggcaacccacacctgctggagggttccctctctgccttcctgccgtccctcaacctggcccccaggctgtctgtgcccaacccctggatccgctcctacacactggcaggaaaagaggagtgggaggtcaatcccctttactgtgacacagtgaaacagatctacccgtacaacaacagccagcggctcctcaatgtcatcgacatggccatcttcgacttcttgatagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagtcggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaatcgcagcggccgatccaaattgtaggaacaaagggggccgacaaagtatatagg

SEQ ID NO: 344024 - DNA, 313 bp, Homo sapiens
atcctgttaactagtctcctcactgtaacaagccatactcttctaagttttaataataatagtaataacagcccatactgcttatggtcaggcaatgttctaagtgctttagtacaaaaacatttgttctcacaataattctggaggagtaataattgtaatatctatttttcaggttactgaggctaagagagcttaggtaacttgcctagagtcacacagctaggaggttaccccagagcctcccatttgagatggggaggggcctccagatttgctttcatttgaggttttcttttttcttattctgatt

SEQ ID NO: 344025 - DNA, 723 bp, Homo sapiens
  misc_feature (680)..(680): n is a, c, g, or t
  misc_feature (687)..(688): n is a, c, g, or t
  misc_feature (696)..(696): n is a, c, g, or t
  misc_feature (701)..(701): n is a, c, g, or t
tcagttgaattcactggcgatggaatatgacctcttacctgactggctgctgctcctcggttctctttggtggctctcctcctcatctccacctctagatatcggggtaccccagagattagctccaggcctcctctgctctatacacattctctctctgggtgattctagctacacctctggcaaaatttagctaatctccagtcctgacctctcccctgctccagattcaaatatccaagtagctgcttgacagattcatttggagaccaggtaggcacctcaaaacttaacgtgtccaaaacatgaatttattttctctcctccctcacccccatcctgaccctttccctgtcttccctcatgtctacaaatggccaccccatgcaaccagttgctctggcaaaacttagtcatcaacctcaatttatctcttctttttatcacaccatgcccaactcacctacaaatcctgcaatatccctacacagccccttctcgccagctccactgccaccaccctaatcccagctgccatcacctctcaaggggattactgtaatagtcagctacctggtctctttgttcctactcttgcccctctacattctatttttcacacagccaccacagtgatcttttaaaaatgtgaatcatggtcaatccatcgcaaggtacgngctcatnntatctgcnaggtncccaaataaaaaaagaaatgtt

SEQ ID NO: 344026 - DNA, 410 bp, Homo sapiens
tactcataattatcttcccattctggcatttgattatatcattgtcatcatcaaaaaatgatcaatttaaaacatttttcaaaaattttaaagattgatacataagagatgtacatattttcagtgtacatgtgataatttaatacattcacataatttgtaaagatcaattcaatgtaattgggatatctattaccttaaatatttgtcttttctttatgtcagaaacatttgaattattctcttttagataatttgagatataaaatagattactgtaaactataatcaattgtaaactatgatcaatttttaaaagaaaaattatttattttggaaactccaagctcaactattaattttcccccaaatctagcaattattaactataatccttcattagtcttcgt

SEQ ID NO: 344027 - DNA, 905 bp, Homo sapiens
agcatgctgccttcaagcatctgtttaacaaagcacatcctgcaccgcccttaatccatttaaccctgagttgacccagcacatgtctcagggagcacggggtaaggttacagattaacagcatctcaaggcagaagaatttttcttagtacagaataaaatggagtctcctgtgtctacttctttctacacagacacagtaacaatctgatctttcttttccccacacattactgataagaacgttgttgataggtaagattaccagtgtaggctgggagtggtggctcacccctgtaatcccaacgctttgagaggccagcgtgggcggatcacttgagcccaggagtttgagatcagcctgggcaatatagtgagacctcgtctatgtaacaacagcagcaacaaaatcttagcactttggggggctgaggcaggaagatcacttgagcccagaaattcaagaccagcctgggcaacgtagtgagaccccatctctataaataaataaaaataaaagcaaataatttaaaagaataaacattgtgaacatcaattcccatcacagcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagc

SEQ ID NO: 344028 - DNA, 896 bp, Homo sapiens
  misc_feature (1)..(1): n is a, c, g, or t
  misc_feature (24)..(24): n is a, c, g, or t
naacttacggctaggtacgaggcngggtggtccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagc

SEQ ID NO: 344029 - DNA, 214 bp, Homo sapiens
gtggtgtacatgacttgagcccctctagacgtgaggcttcctacatgtatacggctgcgagaagacgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagc

SEQ ID NO: 344030 - DNA, 800 bp, Homo sapiens
  misc_feature (98)..(98): n is a, c, g, or t
  misc_feature (103)..(103): n is a, c, g, or t
  misc_feature (106)..(106): n is a, c, g, or t
aatcctgagaacctggccaccctggagcgctatgtagagacgcaggccaaggaaaatgcctatgatctggattgtacctgtcgatacccttgagcaanttgcncangggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgagtggtgacccacggcctcgggctttggggctaagggggtgcccctcaagggaggccgaggcaggggcccagaggacctgggtagatctgctcgtgttctgggctgggaagtc

SEQ ID NO: 344031 - DNA, 400 bp, Homo sapiens
ttccttggcactttgttctaagcacctcgtttggtcctacaatcctataaggtaggtgcttcttaaagataggaaggtaggtgatgctcagagatgttcagtaacttgtccaagtgacccagctgttaattggcagagctgggatttgaacctagccctccttgctccagagtccatctttttaaaatactgcaccaaactgcctttgtgatggtaactggggcctggaaggagtttatgatctccccctaaagaattgtgggtgctgtagcaggtggctggaggtttgtctcccgcccttctcaccttcagtctggtctctccttccccacaggtgtgtccagcatcatggcctcctcccagtaacttcaggtgtttaataaagatgtgttgactcagc

SEQ ID NO: 344032 - DNA, 750 bp, Homo sapiens
  misc_feature (98)..(98): n is a, c, g, or t
  misc_feature (103)..(103): n is a, c, g, or t
  misc_feature (106)..(106): n is a, c, g, or t
aatcctgagaacctggccaccctggagcgctatgtagagacgcaggccaaggaaaatgcctatgatctggattgtacctgtcgatacccttgagcaanttgcncangggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagc

SEQ ID NO: 344033 - DNA, 797 bp, Homo sapiens
  misc_feature (1)..(1): n is a, c, g, or t
  misc_feature (24)..(24): n is a, c, g, or t
naacttacggctaggtacgaggcngggtggtccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagc

SEQ ID NO: 344034 - DNA, 1110 bp, Homo sapiens
gcgaggaagaagtcacgtggcagccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagcaaaaaaaaaaaaaaaaaaaaaaaaaaaaaaaaaaaaaaggggggggaaaagggggggggggggaaaaaggggaaagagagaagggcgcagggggcaaaaggggggcccgggccccaagattcgggggaaacagggggggaacacggggggggccccataagggggagggacaaaaattggcgaaaaaccggggtacccgcgaaaggggtgcgacaaacgcgc

SEQ ID NO: 344035 - DNA, 1183 bp, Homo sapiens
gcgaggaagaagtcacgtggcagccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagcaaaaaaaaaaaaaaaaaaaaaaaaaaaaaaaaaaaaaaaaaaaaaatcgggggctttattcgggggggggaaaaaaggtgtataatagaaagagggcgacaaggaggctacgaaaagtagttatcacgaggaccccaatttttttgtgaacaaggggtgaaactacgggggggcccccaaaataggggaggagccggaataattttgggaaaaacgcggggtcaccgttgtttatgttgtttctgtgtaacgggagtaggagaaaaaactagaagaaaaagagaaagataaagag

SEQ ID NO: 344036 - DNA, 810 bp, Homo sapiens
gcgaggaagaagtcacgtggcagccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagc

SEQ ID NO: 344037 - DNA, 840 bp, Homo sapiens
gcgaggaagaagtcacgtggcagccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagc

SEQ ID NO: 344038 - DNA, 726 bp, Homo sapiens
acaatcgagctcgcggtaccggcatgtgctgtaggccagcgtgggcggatcacttgagcccaggagtttgagatcagcctgggcaatatagtgagacctcgtctatgtaacaacagcagcaacaaaatcttagcactttggggggctgaggcaggaagatcacttgagcccagaaattcaagaccagcctgggcaacgtagtgagaccccatctctataaataaataaaaataaaagcaaataatttaaaagaataaacattgtgaacatcaattcccatcacagcaagccctggatgaaaacatggacctcttggaaggtataactggctttgaagactctgtccgaaagtgtaagtccctctctgaggctgggctccccaaggggaaggggtagggagtggcagccaggtccggggggacagctgctcaccggttttgtctctgacctccacagttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagc

SEQ ID NO: 344039 - DNA, 1363 bp, Homo sapiens
gcgaggaagaagtcacgtggcagccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggggtaacgccctctgggtcctggtgcacatctgggaggttgggggtggctagggcagtggacctcagtcagctcctccaacaggcctgtctgggtctcatcaggtcagcatggaaggcccagcccaaggaggaaataagaacttggtataagacagtctctgccttgagggagatcctatgccatttgctcatttattttgcattaattgagtgcctaccgtgtgtcagtgtgctaaactgggcgtgcagcagtaaacaaagtgggatggctccaattcattctcatggaggtagcaaagcacatggcgacatggaggtgtccagtggtgattcctgtcatgaaggaaagcaagacagctcacagaccagcggcatctgagcccttacctccgtagagagaggcccgtggcctgaggtagtgcagaggaggatagtagagcagggccctgacttgtaacgttcatgggtagccagggtgtatgtggccagagcagagtaagcatgggcgaaagtagagagctgggggttggaggggcatttccaggtcatgtggggcctcgggaggaccttgtcctttcccctgactgagaaggagccaccggagggctctgagcagggtagggctctgatcagatggatattttttaaagatccccccaagaacaaa

SEQ ID NO: 344040 - DNA, 1130 bp, Homo sapiens
gcgaggaagaagtcacgtggcagccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagcaaaaaaaaaaaaaaaaaaaaaaaaaaaaaaacccgggggctcattccgtgggcggcagacagatgtcagggtaagggcccagggtcaataattggtccgcaacccttttctggacaagggggaacgcgcgggcctcaaagagtagtaaaccgaatcgctgggcgtcgactctctcagccacaacagtgacacgacacatcaatacatatgcttacacactatagacgacatcatcgactcactactatctcactaggcgaccatgtcgcctacttctacacacacatgcgcataacccactcaaaacgcgaacaatacaa

SEQ ID NO: 344041 - DNA, 995 bp, Homo sapiens
gcgaggaagaagtcacgtggcagccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggagcctccctctgtcgcccagtctggaatgcaatggtgtgatctcggctcaccacaacctccatctcctgggttcaagcgattctcctgcttcagcctcctcagtagttgggattacaggaatgtgccaccacgccctgctaattttgtaattttagtagagtcagggtttctccatgttggtcaggctggtctcgaactcccgacctcaggtgatccgcccgcctcagcctcccaaagtgctgggattacaggcatgagccactgtgcctggctgatttctttatttttagtagagacagggtttcaccctgttggccagggtagtctcgaactcctgacctcaagtgatccacccacctcagcctcccaaagtgctgggattataggtgtgagccaccacacatggcctggtagctgctattcttgttaacattactgaaggg

SEQ ID NO: 344042 - DNA, 783 bp, Homo sapiens
  misc_feature (1)..(1): n is a, c, g, or t
  misc_feature (24)..(24): n is a, c, g, or t
  misc_feature (759)..(759): n is a, c, g, or t
naacttacggctaggtacgaggcngggtggtccggaaagcgtggcggctgctgctagagcctttccctttaccgcacccaaggagctggagcgacaacaacgacgtcgtttccgtttccaccacctcttcctgttcccgtccttgaggacgccgtgccgggtcagtggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagatatggtctccagtanttcggttgataaggttgttgctcg

SEQ ID NO: 344043 - DNA, 1062 bp, Homo sapiens
  misc_feature (994)..(994): n is a, c, g, or t
  misc_feature (1029)..(1029): n is a, c, g, or t
  misc_feature (1031)..(1032): n is a, c, g, or t
  misc_feature (1042)..(1042): n is a, c, g, or t
agcatgctgccttcaagcatctgtttaacaaagcacatcctgcaccgcccttaatccatttaaccctgagttgacccagcacatgtctcagggagcacggggtaaggttacagattaacagcatctcaaggcagaagaatttttcttagtacagaataaaatggagtctcctgtgtctacttctttctacacagacacagtaacaatctgatctttcttttccccacacattactgataagaacgttgttgataggtaagattaccagtgtaggctgggagtggtggctcacccctgtaatcccaacgctttgagaggccagcgtgggcggatcacttgagcccaggagtttgagatcagcctgggcaatatagtgagacctcgtctatgtaacaacagcagcaacaaaatcttagcactttggggggctgaggcaggaagatcacttgagcccagaaattcaagaccagcctgggcaacgtagtgagaccccatctctataaataaataaaaataaaagcaaataatttaaaagaataaacattgtgaacatcaattcccatcacagcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagcaaaaaaaaaaaaaaaaaaaaaaaaaaaaaaaaaaaaaaaaaaaaaatcgggggctttattcgggggggggaaaggggtttgaatgggcntggtctatggttccggccccgttttgtcaaggggnanntgcggcccanagggggtatcaaccgtacta

SEQ ID NO: 344044 - DNA, 1793 bp, Homo sapiens
ggttcactctctgtccgttgctagggtgagcttgaacaaatgctgatataccagatccagacaaaggtcttcctacatctgtctgtgagttgggactctcagaatgataggccacactttctcctagtggcgggccatgcctctgaggaactaaggattctttagaacctttccagctctgtttgcggttaactgattgctgcacattccctggtttcatgctggcattaataggtctggcagctgctgcagccatctgctctcgtcgaggatcttggtaactcattttactaatgaattcaattgctgcttctatacttctgttgttagttttctgaagagcttgtataaccatatcctcatcaaatccagcagcttgcaagtcttgaagcatttgtggattaacttctgaagtactccgagaagaatttgtttcatttgcaaatggaagcagagagtttcgaatttcctgcaaggctttatgatgcgtcccaaatttgggtggatttctgacttgtcgaggatcttcggttgacattttactcatgttatgctcagccttagcagcatcagatggtttagataaattcctaagggattcccgaatttcttgtaacatttgccggctactgacagtatagttactggcaggaaaggtcttaggcctcatttgtctatatccttctggcttttcactcctcttcatgaaaacatctatatatgtagcccacacgaaggacttctttatttgatagatccagagctttcttctgagcaaaagtgaaaatgatgcttcaaggaagtccccaggactgttaaaattctttacaatataaataattaactctggaggggagagcagagctcctggacagcggccacgggcctgagggcggacgctgaggcggccagagtccgtcccagcaaccccaagtatccctggtggggcagagcggggagacgaacgggggggctgccgcgggccagcgcggcccgtcccaggggtcgtaaggacctggctctccccttaacaccaggccaccgccgccgccgccgccattttgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagc

SEQ ID NO: 344045 - DNA, 377 bp, Homo sapiens
ttccaagacgtccatgttttcatccagggcttccagaaggcctggaaatggcaggtctccagcaggtccccgaggtacaactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagc

SEQ ID NO: 344046 - DNA, 888 bp, Homo sapiens
gcgaggaagaagtcacgtggcagccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagc

SEQ ID NO: 344047 - DNA, 799 bp, Homo sapiens
  misc_feature (1)..(1): n is a, c, g, or t
  misc_feature (24)..(24): n is a, c, g, or t
naacttacggctaggtacgaggcngggtggtccggaaagcgtggcggctgctgctagagcctttccctttaccgcacccaaggagctggagcgacaacaacgacgtcgtttccgtttccaccacctcttcctgttcccgtccttgaggacgccgtgccgggtcagtggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagc

SEQ ID NO: 344048 - DNA, 1458 bp, Homo sapiens
gcgaggaagaagtcacgtggcagccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagcaaaaaaaaaaaaaaaaaaaaaaaaaaaaaaaaaaaaaagggggggggggatctataaaaggttatctccctctgggggggccaaagttatacggggttccccaggtttctggtggtgaaaaggggggctccctatatatgggagagctggaattatatataaggcatgggcccggggcgcggggttttaaaaaggttggggaagggggaaaaagtgggaaacgtgtggggaatcttgtggggaagaggaacacctttaatttgtgggggggtgggaacaaatattgcggacacaaaaccatccccatacaagagagaatttaaaggcgcctctagaggggaaccacttaatacaaagtttacagagcgggtgtcgtatataccggtgcttgtgtccacaaccctacagcgcgcgccacaaatatgtgacatgcggaacgagcatatagagagacaacattgttgcgggcaaaaaacgcgaaggcgctatatgatgaaattctttcgtgcaaacacattttctttattataccacggggggaggcccgatgagcgatacaccaaacaaggg

SEQ ID NO: 344049 - DNA, 1022 bp, Homo sapiens
  misc_feature (1)..(1): n is a, c, g, or t
  misc_feature (24)..(24): n is a, c, g, or t
  misc_feature (954)..(954): n is a, c, g, or t
  misc_feature (989)..(989): n is a, c, g, or t
  misc_feature (991)..(992): n is a, c, g, or t
  misc_feature (1002)..(1002): n is a, c, g, or t
naacttacggctaggtacgaggcngggtggtccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagcaaaaaaaaaaaaaaatcgggggctttattcgggggggggaaaggggtttgaatgggcntggtctatggttccggccccgttttgtcaaggggnanntgcggcccanagggggtatcaaccgtacta

SEQ ID NO: 344050 - DNA, 1025 bp, Homo sapiens
gcgaggaagaagtcacgtggcagccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagcaaaaaaaaaaaaaccgggcttttttggcggaaaaggttagaaaggcaggcttatgtccgcccgttttgtaagggaatccggccaaggcgtatctacgccttctgaaacagaggaaggaaaaaaaacccacaactagc

SEQ ID NO: 344051 - DNA, 916 bp, Homo sapiens
  misc_feature (916)..(916): n is a, c, g, or t
gcgaggaagaagtcacgtggcagccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggtgcggacacgcggctagggggagagcacatcgcgggtgccaaagtaggggaatcttctcgtcgccaagacactacccacctcgggaagatcagagcgcgaccacagcccccactgttcatttcggtgacacaaacggccgctgccggcgtcgtctgtcgccacgagagtcgcgtgatatcggcatcacaaaaaacaccaaaagacgaaccacacagctgn

SEQ ID NO: 344052 - DNA, 1467 bp, Homo sapiens
gcgaggaagaagtcacgtggcagccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtgtaagtccctctctgaggctgggctccccaaggggaaggggtagggagtggcagccaggtccggggggacagctgctcaccggttttgtctctgacctccacagttatctgccatgttgtgggtatcacttaccagcacattgaccgctggctgctggccgagatgctcggggatctgtcggggtaacgccctctgggtcctggtgcacatctgggaggttgggggtggctagggcagtggacctcagtcagctcctccaacaggcctgtctgggtctcatcaggtcagcatggaaggcccagcccaaggaggaaataagaacttggtataagacagtctctgccttgagggagatcctatgccatttgctcatttattttgcattaattgagtgcctaccgtgtgtcagtgtgctaaactgggcgtgcagcagtaaacaaagtgggatggctccaattcattctcatggaggtagcaaagcacatggcgacatggaggtgtccagtggtgattcctgtcatgaaggaaagcaagacagctcacagaccagcggcatctgagcccttacctccgtagagagaggcccgtggcctgaggtagtgcagaggaggatagtagagcagggccctgacttgtaacgttcatgggtagccagggtgtatgtggccagagcagagtaagcatgggcgaaagtagagagctgggggttggaggggcatttccaggtcatgtggggcctcgggaggaccttgtcctttcccctgactgagaaggagccaccggagggctctgagcagggtagggctctgatcagatggatattttttaaagatccccccaagaacaaa

SEQ ID NO: 344053 - DNA, 709 bp, Homo sapiens
gcgaggaagaagtcacgtggcagccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctgggtaacttccctggggtccaggggcaggggagatggcagggccatgtggagctgagtgctaaaagtaacaacggtgcacactgactggcttcctgctttggcggtgggcccagtgctctgcatgtgtgtgtttgtggaattatcatcctctcgcggagc

SEQ ID NO: 344054 - DNA, 354 bp, Homo sapiens
aggagaagacagtaaatagttaggagcgttacgataggcgaagtacacagggtggtagggatagacaacagagggacatacagaagtccaggggattagggaaaagactcctggcagaaatgttgtttaggttgaggcccaaaaaggtgagtaggaaccagcaaggtaaaaggggtttgggaggagagtagtctaggctgagagagtagcttggtcaaaggctgggaagtaaaagaacattgtggatgatgtgttgaggatggatcacatcccagaaaacaaaactggaaggtaggagaccacttgctgttgaagtagaagctggtggtgacttgttcataaaaagagacagga

SEQ ID NO: 344055 - DNA, 236 bp, Homo sapiens
actcactcctgtgggaaagtcattcaatctcagggctttactatctgtgctgacgctccagattttataggtctcagtcagacctctgaactcccgtctccttcatcacaactgcctatttgatagcccatctcagatgtcaaacaggtatatgcatatttaaaaccaaatgcctgatcttccgaatgaccagttctagtagtacatctcattaagtgggactgcaggaaagcagt

SEQ ID NO: 344056 - DNA, 436 bp, Homo sapiens
cttttaatggctagaaggagaatcatggggttggaagtccaccagtttgggtattctgttccctaactcaaaataaagagatgttattttcaagtcttctgcttgttaacttaattagagatacatgagtttgcagctgtgctgggcatgccgcagcttggcatgtttagtccagaaggcatattataatgtacatggaagattgtcagaaattcaaaaggactttttgagtatcacatgtgtattttcaagttccaatatagattcacattcagtttgacaggtatctttggatgcctatcagttaagaactatttattagttgtggaataaaatagggtaaaataaggaacaactgaggaaaaaacataaaatttgctttgtgaataaaagttgtcttcaaaattatgactttttccatcccacaaaagttttg

SEQ ID NO: 344057 - DNA, 623 bp, Homo sapiens
aggacttgaaggaagccctctgggttgtctgctgagtacaggggctcagtgaacactggcgctgcctctgagtcggggctgggctgcagaggcgactcagaggagactctgctgcttgctcccagccccttccccggcgatgcccatcacactgtgacctcccatccctgaagggcacctgcctgagggcctggcctccttccagcttcatggacctggagatgtgccctttcatccttcctgcttcccaggccagtagatccgtttacacttttgggtcgacagtcagcttttccttttggttttggcgggtcccagaggcatgggtgtccagtccaatgtggggagccacgtgacaacgtgggggactgggacatgggactgggaagtcagcagacgctgggatagagagggccctgaacaccaggctcaggggcttgcttggtccttatcctgtaggaggtgggaccacctttccctgaactttctctacaacccttgggagcgtggggaggaggcggctggttccagggtcagtttactaagttagagatttggaaaacctgtgtcagctgtaactcctaggatattttatgtggaacctaacatgcagatgaaagctg

SEQ ID NO: 344058 - DNA, 349 bp, Homo sapiens
ctggctgcctctacacagactcggcgagaggacttgaaggaagccctctgggttgtctgctgagtacaggggctcagtgaacactggcgctgcctctgagtcggggctgggctgcagaggcgactcagaggagactctgctgcttgctcccagccccttccccggcgatgcccatcacactgtgacctcccatccctgaagggcacctgcctgagggcctggcctccttccagcttcatggacctggagatgtgccctttcatccttcctgcttcccaggccagtagatccgtttacacttttgggtcgacagtcagcttttccttttggttttggcgggtcccagagg

SEQ ID NO: 344059 - DNA, 444 bp, Homo sapiens
agtgagattatcatgtacaagagtgagattatcatgtacaagagtgagattatcatgtacaagagatcccaggaatactgacttgatgaaaaagtcacatcagagcactcagtttggcagagcttttctgctgaatgtttactcacattcactgtccaagattctgtactgggggtacatacgtcctctgccctaaggcaattttgagtccaagagacattttgaggcctaaaaatcataggaaactgcccctgagctcacacatatttccaatggtgtccccaatttcagggaatccatggattacctaagccagcccctccagttcggctaagaaactctagtctatatatcaagttttgtatcatatgtattgctctgaactcagaaatttcccttccatttatggattctatgaataaaatatcacatgtacaaaaagac

SEQ ID NO: 344060 - DNA, 466 bp, Homo sapiens
agtgagattatcatgtacaagagtgagattatcatgtacaagagtgagattatcatgtacaagagatcccaggaatactgacttgatgaaaaagtcacatcagagcactcagtttggcagagcttttctgctgaatgtttactcacattcactgtccaagattctgtactgggggtacatacgtcctctgccctaaggcaattttgagtccaagagacattttgaggcctaaaaatcataggaaactgcccctgagctcacacatatttccaatggagctcacacatatttccaatggtgtccccaatttcagggaatccatggattacctaagccagcccctccagttcggctaagaaactctagtctatatatcaagttttgtatcatatgtattgctctgaactcagaaatttcccttccatttatggattctatgaataaaatatcacatgtacaaaaagac

SEQ ID NO: 344061 - DNA, 674 bp, Homo sapiens
tcttccaggggaatcagaaagcaaagaccattttttaatagcatgtgacctgttacaaagagagaattctgaattagaaacaaaggtgagactgagttaggtatttaaatgttcaatatttaatgtagcttttatgaggataggttaaaaggaaattaattttaagcaacagatgatttgggaattggagtttcttctattattatagcataaattgccatatactgccatatactgtggattatgagtcaagctatatgtcaagataaatattcagacttcaaccagcacttggcaattaggattaatctgcaaatttttttactttaaatcagcttcccaccaacttaatttttggagtacatattataatgtaaaatatttatttaaatgtcttcaatttaaaaatttaggatcaaagcatctttctataatgtaaaagatttatttaaatgtcttcaatttaaaaatttaggaccaaagcgtctttctcagttacactgaaaattgggcttagaattaggaaaatgttcaaatgtcctgattcaagcttgttccttaagtttaaaaatggcttccagggagcctaagtttaaaaatgtgcccaggagttagaggctgtagtgtgctgtgattgtgcctgtgaatagccactgcatttcagcctgggcagc

SEQ ID NO: 344062 - DNA, 404 bp, Homo sapiens
gccctagaaacaagaaccaatccagcagcaacaagcatctctggcagtctatcatttcccttcaactgaaatcagatcttcttaaagaaatgcttggctctcagactgggaacggaaatgtacaagatgtgcttcgatatctggtcaaatcagaaactcaaaaagctatcaaagtctctttggactgtgtcagaaagaggtgaaaagactcccacttgccaaagacgggacaatttgagcattcataagactaatcactataatggactatagtgaactgaagtacatcaaatatgtttcaatccatgatttcataatggtatcttaaataattggtcacttgtggaggactctacgtaaccaactcaacaacttgaaaactggtaataaagagaaatccttta

SEQ ID NO: 344063 - DNA, 389 bp, Homo sapiens
aaaaacaatttaagtctgaaaggaatctagcactaataaaggaatatcagattttaggactgatatttccaacctctttgcattcatctatcaccccttgattgatgaacttaccatatatttcaccaagcaattagaagcaatcagaagggcaagcccctactgtctccatccaactccattaaaaaagatgcatttattaatatatttaccatctcttcctactactgtgaaatgtcactactgccttctgaaagccaacctccttacacccttaatggcttcacccctgtttctctttcacatcatcaatatttccctctgtactatgtcatttccatccagcttacaaccatttcctggtgtctcccatctttttctgccatttt

SEQ ID NO: 344064 - DNA, 381 bp, Homo sapiens
tgtggtttatgaaagaggcaaaattgtcaatgactacttgttgaattttgcttcctaaccatgtaatggggacaagtgtttccgaaaacatgttttatatggttagttttcctgcagatgggaattgttcgctgaattatactttgtccacttaggcttaggtagatatggattctgtgaaactggaaatcattgaatggtttaaatactggattaaaagaaaaggaactatggtaattgcagatctgttagatggaatctgtcgtgccctaataagagtgataaggaagaccattaactgttggaagcaagttgttgggttcgaggttgggaattgggcatgatttgtttcctgtgtcactacttaggttaatttactca

SEQ ID NO: 344065 - DNA, 541 bp, Homo sapiens
tttactgcacaaagggtcaaaattttatgtaaacaattttaatcatttaagaagtcagggaatcacaggaatgcagactgtgacaagagaacataactattagtacaaatgtaggaaacaaactcaaaagagtaggggtgaaaggtgctgatctaagtaactttggaaattactgaagtttgtaagactaaaggcaaaaggaactgcaagtaagcagttcctagttgatacaagttgtttcccatgggggttatagggaagcttaaacattccctctggaggtttgataattaagtctgctgaaatgaactgacaataaacagattaagaagagaaagaccattttaattacatacatgcaaatggaagcctcagaaaaatatgagactcaaaggaggaggcagatggttgaaggtttcatagcataaaatgaataggggcttgaaggggaggtgatgacagttatgagaggaaaaggagaggaactgcatggtgaacaaagattgtcttatgtaaataaagtctctcaggtcataaaagt

SEQ ID NO: 344066 - DNA, 655 bp, Homo sapiens
accgggttatttacccccatccggaaaaaaataagaaagtgttatttgtggacgccgcagatatacgatccaaggtcgcagattctttggtccatataaaatcactgggcacctgtttttaaggacaggccatttctgctataccccagttataaaaaggtgactgtttatataaataggaatagtagcctgggttttggtgaacctgttgtagcgtgtgtaggttataaaaaatttcagaattccaatttcttcataaaataaagataatgtaactttacttacaggcttttttctctgccaagcactaagtcgatacatacaaatcagtgatcacagtacctggcacatagcaggtcttcagtatctgctttacttctttcccttcgcctgaggtaggatatgaacatttgaaatagacctagccttgtcaggcataataagaaagatataacatcagagtttaaaaaaaaatagctgaacttttggttggcacacttttgcttatattgatgactaaacagataaactggtagagggtagagaaacttgaagttcaaatgagtatttgttgaagagaaatcaaaatcataagcatagtatctaagatatgatgtcagttaggaaacaatttaatcttgtggcatctgcagga

SEQ ID NO: 344067 - DNA, 4127 bp, Homo sapiens
  misc_feature (2944)..(2944): n is a, c, g, or t
  misc_feature (3542)..(3542): n is a, c, g, or t
cggtttgctataatttcttaaaattcaatcaatttcacatccattaaacttacaagtaccgtaatccagttttcctaggaaaactaagcccagccgaaccttgggaaaaatacctctgtgttaaacatatatacatgatcgattttaaatgttttcaccacaaaaaatggtaagtacgtgaggtgatggatttgttaactcagaagcaggcacaccaaatcacaatgggtctgattcgatcctccctgatggcaatggagacccatctaactaatcccacttctaattacctttctttttctccttacagacctaaaaaatctcaccatttctattagcctgaaaatccctctgttcttctcttcctccttcagcactgaatctcgcttacactaggttttacttaatgattctcctccttatactttctgtctcaccagtttcctctcacacttatttacctgctacacaaaattattcttattgggcttatgtgccctttcctccacttattcgacctctcacctggattgatgctcctgcggaaatctacattaacgatagtttgtggatgcctggagctacagatgaccgttgccctgctcaaccaggagaagaaggcactacatttaatgttatcatgggttataaataacaccctctgtgcctcagaaatgcacctggttatatccatctagaaactcaagtctgggctgcttatcttcccgagggatcagctacagaggaaccgggacatttggtctctggcctctccctttctcctttaaaacaaatgaaagggggagtaatgggacataccccatactttcaataagtagcctccaggcattcccttccaccagaggagcaattgttttttaaatagccctttggcgcccagtctattactaaaccatatgagtcattttttaatattactgcatgtgagttaacatagtcttcccaaattaaagttttagatgggccctcaaaatttttagggcatggttttcctgcaggtttatatggaaagtatggggtccctgacttctcgcaacagtggcctacactgcctttcagttctgtacctaggcctccaaagcactttagcctgtggggcttgccagaactcgggttccagctcctggaatggacagttcccctctggctagggttgatctaatgttccctctgggttactggctgagttctgccctgtgtggctttctgctgtgccagggctgcactgagttcaaatgcagagtctcacaatcattgtattcttcctcccccaggagcacccattctctctttacaccaattggccactgccaggggatgaagagggatgatgttgacaattcaagactatttcttaccctcttcagtgcctgtttccttaatatgataataaaccaggtactgcgatcactcacctgattattggttcttatgaaggtgcttttttaatgtagttgttcagtttgatatttctgtcggagggatgactgctggaggattctattaagccatcttgctctgccttcttgcaacacataaaattcaacagttttgtgcaactgtaagttcaagtgtttgtaattttatttatttcatttttttctttgagatgaagtctccctcttgttacccaggctggagtgcagtggcgcgatcttggctcactgcaacctctacctcctgggttcaagcaatcctcctgccttatcctcccaagtagctgggattacagatgcctgccaccatgtcttgctaacttttgtacatttagtagacatgaggttttgccatgttgtccgggctggtcttgaactcctgacttcaagtgatccacctgtcttagcctcccaaagtactgggattacaggtgagagtcactgctccctgctgcaaatttcttattaaatctgtttgacagattttagaatttctataagtaatgtttaaaattacaaccatttgggctgggtgtggtggctcatgcctgtaatcccagcacttattttatttcttatcaggagaacgagaatcatcatactactttgcatcggaggttaagctcattcttttccttaaaatgggaagataaaggcattaccccctctccgaggcctcatatgatactccccattctgacccagaacacccagaactttggaaattggctattgccatgtctggactgcaagtatgggaagcagaaactattctgtctgttgtccccactaccatctccctctctcagtatcaacgtagatccagacattctgctttacctacctccaacctgtttccatacagagttctgttaagcctccttgcatgctgttagtgagatatatcaaaatttggatgaacaatcaaactgtccaatgcattaattgtcatttatacacttgtattaactcccattttgattccaggaaaagtgtaatgttggttcgagctcaagaaggaatctggattccggtaactttgcccagaccttgggaatcctccccttcaatacatttaattaatgaagtgttacagtgaattctaaaaagatctaagagatttattttcactttaattgctgttatcatgggcctaattacagtcactgcagtggccaccactgccggaatggcattacaccagtccattcaagcggctcattttgttaatggttggcaagccaattccatccaaatgtggaattctcaacaaggcatcgatcgaaaattggcaaatcaaattagtgatttaagacagtctgttatttggcttggagatcaggtagtgagtctcgagcatcacatgcaaatgcagtacgattggaacacttgagatttctgcatcaccccgtattcctataacgagactgatcattcatgggaaatggtcaaaagacatcttctgggtagggaagataatttatcantggacataactaaattaaagagacaaatttttgaagcctctcaagctcacttatccattgtgcctggagctgaggcgttagatcaggtggcagaaaatctttctggattaaaccccaggacttggattaagtctattgggggctccactgtagtaaattttggaattatgtttctctgtttaatcggcttgtttttagtttgccagactagtcaaagaatcctgcgtcaaaatcaagagaacgaacaagccttcattgccatggcacatttattataaaaagaaagggagagatgttgcgggaagtcagggaccccggagggaccagctgaagccatggcagaagaacataaattgtgaagatttcatggacatttattagttccccaatcaatacccttgtgatttcctatgcctgtctttactttaatctcttaatcccgtcatcttcgtaaactgaggaggatgtatgtcgcctcaggaccctgtgatgattgtgttaactgcacaaattgtagagcatttgtgtttgaacaatatgaaatctgggcaccttgaaaaaagaacaggataacagtgatgttcacggaacaagaganataaccttaaactctgactgccggtgagctggacggaacagagccatatttctcttctttcaaaagcaaatgggagaaatatcactgaattctttctcagcaaggaacatccctgagaaagagaatgcatccctgagggtaggcctctgaaatggctgcttcagggcagctgtcttttatggtcgcagctgtggggatgaaataagccccagtttctcagagtgctcccaggcttattaggacgaggaaattcctgcctaataaattttggtcagaccagttgtctgctctcaaaccctgtctcctgataagatgttatcaatgacaatgcatgcccgaaacttcattagcaattttaatttcaccccagtcctgtggtcctgtgatctcgccctgcctccatttaccttgtgatatcttattaccttgtgaagcatgggatctctgtgacccataccctatttgtacactccctccccttttgaaaatcactaataaaaaatttgctggttttatggctcagggggcatcacagaacctgccaacatgtgatgtctgccctggacacccagctttaaaatttct

SEQ ID NO: 344068 - DNA, 525 bp, Homo sapiens
gcctttccagtttctcagaagcctagcagtacttactcctcctgctcttgggttcttttttactttttttttttttttttaaaaaaaaccttgaactcttaaggattaatgctcttgagttatgagatatccctacattccaataactctaccttctatttttattgattaaactagtttgagtagtttctgttcctttcttccaaaacaacccactgagaacttggaaataaggcaaactagatttccctctaatagttaaattggcattctctgagaatatttataaatgtgttaattgaaaaattttggagtgtggtggctcacacttgtaatcctagtgcattgagaggctgaggtgagaggaccatttgaggccaggagttagagactagtctgggcaatgtagtgagaccccccaactctacaaaaaaaaatgttgttttgttttttttgtgtttttgttttgagatagagtctcgaactccagcctggatgacagagcaagactctgtctcactgcaa

SEQ ID NO: 344069 - DNA, 682 bp, Homo sapiens
gcctttccagtttctcagaagcctagcagtacttactcctcctgctcttgggttcttttttactttttttttttttttttaaaaaaaaccttgaactcttaaggattaatgctcttgagttatgagatatccctacattccaataactctaccttctatttttattgattaaactagtttgagtagtttctgttcctttcttccaaaacaacccactgagaacttggaaataaggcaaactagatttccctctaatagttaaattggcattctctgagaatatttataaatgtgttaattgaaaaattttggagtgtggtggctcacacttgtaatcctagtgcattgagaggctgaggtgagaggaccatttgaggccaggagttagagactagtctgggcaatgtagtgagaccccccaactctacaaaaaaaaatgttgttttgttttttttgtgtttttgttttgagatagagtctcgaactcgccctgcctccatttaccttgtgatatcttattaccttgtgaagcatgggatctctgtgacccataccctatttgtacactccctccccttttgaaaatcactaataaaaaatttgctggttttatggctcagggggcatcacagaacctgccaacatgtgatgtctgccctggacacccagctttaaaatttct

SEQ ID NO: 344070 - DNA, 2790 bp, Homo sapiens
caggggagaagacatgtaaacgtgcctccagaggaagggctgggggagctgggagtggcgggggcggcggaaggtgagcctgggaaggtggccgagcaccccttcttcttgggcccttcccagtgctcccttggggtgtcagccccagccccgtttgcccccactccgcctcccttttggaagggattgccttttttttcctctgcggcggcggaaatgacagtgtggtgctgccgtggtgtcatggtgctgcccctggactgaggggcgaaaactcttaagtttagctcgggaggcccagctgcggtagcatcgcggccgccgtgctgtcccctgcggggcgcgcgggctggcggatcccggctgctgcgcggcgtcggcgacggtagcggcagcggcggcgaaggcgggcggcggcctacagtggtagcggcggcggcggcgaccggggcccgggagctcgcgccggagcccgagccaacccgctgcggaggcagacgagagcccagcgccctcgagcgagcggaggagatggctggcacctgggaacgctatgggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaactcaagcaaactctggagatgaacctcaccaacctggttaagcgcaacagcgaactagaaaatcaaatggccaaactaatacagatctgccagcaggttgaggtgaatactgctatgcatgaggcaaaacttatggaagaatgtgacgagttggtagagatcatccagcagaggaagcaaatgatcgctgtcaaaatcaaagagacaaaggttatgaaactgagaaagttggcacagcaggttgctaattgccgccagtgtcttgaacggtcaacagtcctcatcaaccaagctgagcatatcctgaaagaaaatgaccaggcacggtttctacagtctgcaaaaaatattgctgagagggtcgctatggcaactgcatcttctcaagttctgattccagacatcaattttaatgatgcctttgaaaactttgctttagatttttccagagaaaagaaactgctagaggggttagattatttaacagccccaaacccaccatctatccgagaagaactctgtactgcctcccatgacaccattacagtccactggatctcggatgatgagttcagcatcagctcctatgagcttcagtacaccatattcactggccaggctaacttcatcagcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagccaaccctttaaattggatcccaaaatgactcacaagaagttgaagatctccaatgatggattgcagatggagaaggatgaaagctctctaaagaagagccacaccccagagaggtttagtggcacagggtgctatggggcagcaggaaatatattcattgacagtggctgccactattgggaggtggtcatgggttcctcaacatggtatgcaattggcattgcctacaaatcagctccaaagaatgaatggattggcaagaatgcctcctcatgggtcttctctcgctgcaatagtaacttcgtggtgagacacaacaacaaggaaatgctggtggatgtgcccccacacctgaagcgtctgggtgtcctcctggattatgacaacaatatgctgtctttctatgacccagctaactctctccatcttcatacttttgatgtgaccttcattcttccagtttgtccaacatttacaatctggaacaaatccctaatgatcctgtctggcttgcctgccccagattttattgattaccctgagcggcaggaatgcaactgcaggcctcaagaatccccttatgtttctgggatgaaaacctgtcattaagtttcaggagagtatataattcactggctctctagttcagcagttcttcccctcctacacctaagttagcgttcaatatacgagacacaaaataaagtttgtttgaagcatccaaaatc

SEQ ID NO: 344071 - DNA, 1216 bp, Homo sapiens
  misc_feature (44)..(45): n is a, c, g, or t
gaacacagaaaaccagtcaatagaaacgaccactgcacgggaannttttcagggtcgctatggcaactgcatcttctcaagttctgattccagacatcaattttaatgatgcctttgaaaactttgctttagatttttccagagaaaagaaactgctagaggggttagattatttaacagccccaaacccaccatctatccgagaagaactctgtactgcctcccatgacaccattacagtccactggatctcggatgatgagttcagcatcagctcctatgagcttcagtacaccatattcactggccaggctaacttcatcagcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagccaaccctttaaattggatcccaaaatgactcacaagaagttgaagatctccaatgatggattgcagatggagaaggatgaaagctctctaaagaagagccacaccccagagaggtttagtggcacagggtgctatggggcagcaggaaatatattcattgacagtggctgccactattgggaggtggtcatgggttcctcaacatggtatgcaattggcattgcctacaaatcagctccaaagaatgaatggattggcaagaatgcctcctcatgggtcttctctcgctgcaatagtaacttcgtggtgagacacaacaacaaggaaatgctggtggatgtgcccccacacctgaagcgtctgggtgtcctcctggattatgacaacaatatgctgtctttctatgacccagctaactctctccatcttcatacttttgatgtgaccttcattcttccagtttgtccaacatttacaatctggaacaaatccctaatgatcctgtctggcttgcctgccccagattttattgattaccctgagcggcaggaatgcaactgcaggcctcaagaatccccttatgtttctgggatgaaaacctgtcattaagtttcaggagagtatataattcactggctctctagttcagcagttcttcccctcctacacctaagttagcgttcaatatacgagacacaaaataaagtttgtttgaagcatccaaaatc

SEQ ID NO: 344072 - DNA, 2880 bp, Homo sapiens
caggggagaagacatgtaaacgtgcctccagaggaagggctgggggagctgggagtggcgggggcggcggaaggtgagcctgggaaggtggccgagcaccccttcttcttgggcccttcccagtgctcccttggggtgtcagccccagccccgtttgcccccactccgcctcccttttggaagggattgccttttttttcctctgcggcggcggaaatgacagtgtggtgctgccgtggtgtcatggtgctgcccctggactgaggggcgaaaactcttaagtttagctcgggaggcccagctgcggtagcatcgcggccgccgtgctgtcccctgcggggcgcgcgggctggcggatcccggctgctgcgcggcgtcggcgacggtagcggcagcggcggcgaaggcgggcggcggcctacagtggtagcggcggcggcggcgaccggggcccgggagctcgcgccggagcccgagccaacccgctgcggaggcagacgagagcccagcgccctcgagcgagcggaggagatggctggcacctgggaacgctatgggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaactcaagcaaactctggagatgaacctcaccaacctggttaagcgcaacagcgaactagaaaatcaaatggccaaactaatacagatctgccagcaggttgaggtgaatactgctatgcatgaggcaaaacttatggaagaatgtgacgagttggtagagatcatccagcagaggaagcaaatgatcgctgtcaaaatcaaagagacaaaggttatgaaactgagaaagttggcacagcaggttgctaattgccgccagtgtcttgaacggtcaacagtcctcatcaaccaagctgagcatatcctgaaagaaaatgaccaggcacggtttctacagtctgcaaaaaatattgctgagagggtcgctatggcaactgcatcttctcaagttctgattccagacatcaattttaatgatgcctttgaaaactttgctttagatttttccagagaaaagaaactgctagaggggttagattatttaacagccccaaacccaccatctatccgagaagaactctgtactgcctcccatgacaccattacagtccactggatctcggatgatgagttcagcatcagctcctatgagcttcagtacaccatattcactggccaggctaacttcatcagtaagtcatggtgtagttggggcctgtggccagagataaggaaatgtaaggaagcagtaagctgctcaagattggccggggcgccacgaggcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagccaaccctttaaattggatcccaaaatgactcacaagaagttgaagatctccaatgatggattgcagatggagaaggatgaaagctctctaaagaagagccacaccccagagaggtttagtggcacagggtgctatggggcagcaggaaatatattcattgacagtggctgccactattgggaggtggtcatgggttcctcaacatggtatgcaattggcattgcctacaaatcagctccaaagaatgaatggattggcaagaatgcctcctcatgggtcttctctcgctgcaatagtaacttcgtggtgagacacaacaacaaggaaatgctggtggatgtgcccccacacctgaagcgtctgggtgtcctcctggattatgacaacaatatgctgtctttctatgacccagctaactctctccatcttcatacttttgatgtgaccttcattcttccagtttgtccaacatttacaatctggaacaaatccctaatgatcctgtctggcttgcctgccccagattttattgattaccctgagcggcaggaatgcaactgcaggcctcaagaatccccttatgtttctgggatgaaaacctgtcattaagtttcaggagagtatataattcactggctctctagttcagcagttcttcccctcctacacctaagttagcgttcaatatacgagacacaaaataaagtttgtttgaagcatccaaaatc

SEQ ID NO: 344073 - DNA, 2282 bp, Homo sapiens
ttccttcaagatgacagggcgctggagaaaaggctgctggaatcagctggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaactcaagcaaactctggagatgaacctcaccaacctggttaagcgcaacagcgaactagaaaatcaaatggccaaactaatacagatctgccagcaggttgaggtgaatactgctatgcatgaggcaaaacttatggaagaatgtgacgagttggtagagatcatccagcagaggaagcaaatgatcgctgtcaaaatcaaagagacaaaggttatgaaactgagaaagttggcacagcaggttgctaattgccgccagtgtcttgaacggtcaacagtcctcatcaaccaagctgagcatatcctgaaagaaaatgaccaggcacggtttctacagtctgcaaaaaatattgctgagagggtcgctatggcaactgcatcttctcaagttctgattccagacatcaattttaatgatgcctttgaaaactttgctttagatttttccagagaaaagaaactgctagaggggttagattatttaacagccccaaacccaccatctatccgagaagaactctgtactgcctcccatgacaccattacagtccactggatctcggatgatgagttcagcatcagctcctatgagcttcagtacaccatattcactggccaggctaacttcatcagcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagccaaccctttaaattggatcccaaaatgactcacaagaagttgaagatctccaatgatggattgcagatggagaaggatgaaagctctctaaagaagagccacaccccagagaggtttagtggcacagggtgctatggggcagcaggaaatatattcattgacagtggctgccactattgggaggtggtcatgggttcctcaacatggtatgcaattggcattgcctacaaatcagctccaaagaatgaatggattggcaagaatgcctcctcatgggtcttctctcgctgcaatagtaacttcgtggtgagacacaacaacaaggaaatgctggtggatgtgcccccacacctgaagcgtctgggtgtcctcctggattatgacaacaatatgctgtctttctatgacccagctaactctctccatcttcatacttttgatgtgaccttcattcttccagtttgtccaacatttacaatctggaacaaatccctaatgatcctgtctggcttgcctgccccagattttattgattaccctgagcggcaggaatgcaactgcaggcctcaagaatccccttatgtttctgggatgaaaacctgtcattaagtttcaggagagtatataattcactggctctctagttcagcagttcttcccctcctacacctaagttagcgttcaatatacgagacacaaaataaagtttgtttgaagcatccaaaatc

SEQ ID NO: 344074 - DNA, 4212 bp, Homo sapiens
  misc_feature (3274)..(3274): n is a, c, g, or t
ggcggggcggcagtggcggttgcggggcatgcgcggctccgcgcgcggcttctcaaacatggcggcggcggtgtgaagctcggtgccggctcgcgcgatcggtgggacagaatttcgttgttttcaccgacgagactggaggaaacaacaccaaatagggataccatgggacaaacagtgaatgaagattccatggatgtcaagaaggagaatcaagagaaaactcctcagtcaagtacatcttctgtacaaagggatgatttccactgggaggagtatttgaaagagactgggtctataagtgctccttcagagtgcttccgtcagtctcagattccacctgtgaatgatttcaaagttggtatgaaattggaagcccgtgaccctcgcaatgccacttcagtatgtattgctacggttattggaattactggggccaggttacggttacgactggatggtagtgacaacagaaatgatttttggaggcttgtcgattccccagacatacaacctgttgggacatgtgaaaaggaaggagacttacttcaacctccactagggtaccagatgaatacatcctcctggccgatgttcctcttaaagacactaaatgggtctgaaatggcatctgccacattatttaagaaggaaccaccaaagcccccactaaataattttaaagtggggatgaaactggaagctattgacaaaaagaacccgtatctcatctgtcctgcgaccattggagatgttaaaggggatgaagttcatatcacatttgatggctggagtggagcttttgattactggtgcaagtatgattctcgagatattttcccagctgggtggtgtcgcctgacaggagatgtattacaacccccaggaactagtgttcctattgtaaagaatatagcaaaaacagagtcttctccttccgaagcaagccagcattcaatgcagtctccacagaaaactactctaatattaccaacacagcaggtcaggagatcaagtcgaattaaaccacctggacctactgcagtccccaaaaggagcagttctgttaaaaatatcacaccaaggaaaaaaggtccaaactcaggaaaaaaggaaaaacctttgcccgtgatatgttctacatctgcagcttctctaaaatcgctgaccagagaccgtggcatgttatataaagatgtcgcttctgggccatgtaaaatagtgatgtctacagtctgtgtctatgtaaacaaacatggaaactttggccctcatctggatcccaagagaatccagcagctgcctgaccacttcggcccgggcccggtgaatgtggtgcttcgccggattgtgcaggcctgtgtggattgtgcccttgaaactaaaactgtttttggatacctgaagccagataatcgtggaggagaagtgataactgcctcctttgatggggaaactcattccatccagctccctccagtgaacagtgcatcatttgctcttcgctttcttgagaacttctgccacagtctgcagtgtgataaccttttgagtagccagccttttagttcttccaggggtcatactcacagctctgcagagcatgataaaaatcagtcagcaaaagaagatgtaacagaaaggcaaagcaccaaacgatctcctcagcaaactgtaccatatgttgttcctctctctcctaagctccccaaaacaaaggagtatgcgtctgaaggagaaccattgtttgctgggggaagtgccattcccaaagaggagaatctttcagaagattctaagagctcatcactaaattcaggaaattatttgaatcctgcctgtagaaatcctatgtatattcatacttcagtctcccaggatttttctcgaagtgtgccaggcaccacaagttcaccactagttggggacatatcccccaagagcagtccccatgaagttaaattccaaatgcagaggaaaagtgaagctccaagttatatagctgtacctgatcccagtgtcctgaaacaaggcttctctaaggacccttcaacctggtctgtggatgaagtgatacagtttatgaaacatacagatcctcagatatcaggccccctcgccgacctcttcaggcaacatgaaattgatgggaaggctctgttcctactcaagagtgatgtgatgatgaagtatatggggctgaagctggggccagcattaaagctgtgttactacattgaaaagcttaaagaaggaaaatacagttaaaaaaatgtgtaagtttagattggacataattctcaggtgtactgttaacattttaatttaaaagtatttctcttagcagtttttgttttgtagacagttcccataaaaatattttatcagaattgcagaactgtagtaacagttcagtcaactttgtttttttcctggagtcaccaaccagctttgggagacacagccgccactcccccagtctacttctttaaaaagcatttaacaggttagtattggcatattcaaattggcagttctttatgtctttttaaattttcattgtacagtttacaaatatacttaatgtagttaacagagaaaaacctttgattttggttaacctttatatctagaaccaaaacagctaaatcccaaaggggaaaatatcagggattgacaacttctataattaaatccatgagaatttttcctcactagagaatttaaaggtgcacctgtagatatcatcttttctcagatattttgtgtgatactctgtggtgttctgttcatgttctatcagtatatctagaaagggaatagccatataaattattttccttttattatttctctgtatgttgtatttgatcatatttaaaggaaaaaagcaagcttataagctttcatgaagtgttcttaccagtttttgataaattttttaaattataggatagaattgtcattttatgcaggagatatttatactacgagggttgtttggatggagtcagattaaattttttcagtgaaattcctattattttaaaactttccatattttcactacgcttggacatttaactaggcattcttttcttacatctctatatgaagatacctgtgtccaaaatttttgaagatatatattgtatgtgtttattcttcatatggtactttaccatatttatatattgttttatacctgtaggtttacacacaagtaaatcttttttttcttgaatttaatctgggcactttgcactgccacagnggtgacgatggaactatgtatatagttaggatgttttgatttcggtaaaaaatatatgtccatcgtttgctatcaccagtacctctcagcttactcttcaggggatatgaaacaatctgtagattggtttccatacagggaagttctctgtcctatgcaatgtttctaattaatttgcttagttctgagccatttattctgctacactttgaaagatatattagttctgacttattgtttggggctttattttatttttatttttttgagatggagtttcactcttgttgcccaggctggagtgcaatagctcgatctcggctcactgcaacctcgcctccctggttcaagcaattctcctgcctcagcgattacaggaatgcaccaccacgcccagctaattttgtagagatggggtttctccatgttggtcaggctggtctcaaactcctgacctcaggtgatccgcccacctcggccttgcaaaatgctgggattacaggcatgagccaccatgcccagccatgtttggggctttattttataagttagaactttgaagaggaaatggtgctatatgtttattgttattactttgtgtaactttgatgtaatgtttataagctatgagaatcagttataaaagtattagccatttgttgtaaatgccaataaaatattcaccaggggcaagaatgtacattttctttttagaaaaccaaatgtactttagacatgaatgcaactatttaaagaatagcttcatttatgttattccttacatgtcataagattcttacttaaacttggtcttctttcaagttgtttgtatgaagatgctgtacccacttgaacagtcctcaggtgtttacataaatactatgttttacagttttcatattttaaaatattaataaagttaatcgcaacgattcaat

SEQ ID NO: 344075 - DNA, 454 bp, Homo sapiens
atttaagcaattagaaaactaaatttagccatgcccagccatgtttggggctttattttataagttagaactttgaagaggaaatggtgctatatgtttattgttattactttgtgtaactttgatgtaatgtttataagctatgagaatcagttataaaagtattagccatttgttgtaaatgccaataaaatattcaccaggggcaagaatgtacattttctttttagaaaaccaaatgtactttagacatgaatgcaactatttaaagaatagcttcatttatgttattccttacatgtcataagattcttacttaaacttggtcttctttcaagttgtttgtatgaagatgctgtacccacttgaacagtcctcaggtgtttacataaatactatgttttacagttttcatattttaaaatattaataaagttaatcgcaacgattcaat

SEQ ID NO: 344076 - DNA, 4060 bp, Homo sapiens
  misc_feature (3122)..(3122): n is a, c, g, or t
ggcggggcggcagtggcggttgcggggcatgcgcggctccgcgcgcggcttctcaaacatggcggcggcggtgtgaagctcggtgccggctcgcgcgatcggtgggacagaatttcgttgttttcaccgacgagactggaggaaacaacaccaaatagggataccatgggacaaacagtgaatgaagattccatggatgtcaagaaggagaatcaagagaaaactcctcagtcaagtacatcttctgtacaaagggatgatttccactgggaggagtatttgaaagagactgggtctataagtgctccttcagagtgcttccgtcagtctcagattccacctgtgaatgatttcaaagttggtatgaaattggaagcccgtgaccctcgcaatgccacttcagtatgtattgctacggttattggaattactggggccaggttacggttacgactggatggtagtgacaacagaaatgatttttggaggcttgtcgattccccagacatacaacctgttgggacatgtgaaaaggaaggagacttacttcaacctccactagggtaccagatgaatacatcctcctggccgatgttcctcttaaagacactaaatgggtctgaaatggcatctgccacattatttaagaaggaaccaccaaagcccccactaaataattttaaagtggggatgaaactggaagctattgacaaaaagaacccgtatctcatctgtcctgcgaccattggagatgttaaaggggatgaagttcatatcacatttgatggctggagtggagcttttgattactggtgcaagtatgattctcgagatattttcccagctgggtggtgtcgcctgacaggagatgtattacaacccccaggaactagtgttcctattgtaaagaatatagcaaaaacagagtcttctccttccgaagcaagccagcattcaatgcagtctccacagaaaactactctaatattaccaacacagcaggtcaggagatcaagtcgaattaaaccacctggacctactgcagtccccaaaaggagcagttctgttaaaaatatcacaccaaggaaaaaaggtccaaactcaggaaaaaaggaaaaacctttgcccgtgatatgttctacatctgcagcttctctaaaatcgctgaccagagaccgtggcatgttatataaagatgtcgcttctgggccatgtaaaatagtgatgtctacagtctgtgtctatgtaaacaaacatggaaactttggccctcatctggatcccaagagaatccagcagctgcctgaccacttcggcccgggcccggtgaatgtggtgcttcgccggattgtgcaggcctgtgtggattgtgcccttgaaactaaaactgtttttggatacctgaagccagataatcgtggaggagaagtgataactgcctcctttgatggggaaactcattccatccagctccctccagtgaacagtgcatcatttgctcttcgctttcttgagaacttctgccacagtctgcagtgtgataaccttttgagtagccagccttttagttcttccaggggtcatactcacagctctgcagagcatgataaaaatcagtcagcaaaagaagatgtaacagaaaggcaaagcaccaaacgatctcctcagcaaactgtaccatatgttgttcctctctctcctaagctccccaaaacaaaggagtatgcgtctgaaggagaaccattgtttgctgggggaagtgccattcccaaagaggagaatctttcagaagattctaagagctcatcactaaattcaggaaattatttgaatcctgcctgtagaaatcctatgtatattcatacttcagtctcccaggatttttctcgaagtgtgccaggcaccacaagttcaccactagttggggacatatcccccaagagcagtccccatgaagttaaattccaaatgcagaggaaaagtgaaggaaattgatgggaaggctctgttcctactcaagagtgatgtgatgatgaagtatatggggctgaagctggggccagcattaaagctgtgttactacattgaaaagcttaaagaaggaaaatacagttaaaaaaatgtgtaagtttagattggacataattctcaggtgtactgttaacattttaatttaaaagtatttctcttagcagtttttgttttgtagacagttcccataaaaatattttatcagaattgcagaactgtagtaacagttcagtcaactttgtttttttcctggagtcaccaaccagctttgggagacacagccgccactcccccagtctacttctttaaaaagcatttaacaggttagtattggcatattcaaattggcagttctttatgtctttttaaattttcattgtacagtttacaaatatacttaatgtagttaacagagaaaaacctttgattttggttaacctttatatctagaaccaaaacagctaaatcccaaaggggaaaatatcagggattgacaacttctataattaaatccatgagaatttttcctcactagagaatttaaaggtgcacctgtagatatcatcttttctcagatattttgtgtgatactctgtggtgttctgttcatgttctatcagtatatctagaaagggaatagccatataaattattttccttttattatttctctgtatgttgtatttgatcatatttaaaggaaaaaagcaagcttataagctttcatgaagtgttcttaccagtttttgataaattttttaaattataggatagaattgtcattttatgcaggagatatttatactacgagggttgtttggatggagtcagattaaattttttcagtgaaattcctattattttaaaactttccatattttcactacgcttggacatttaactaggcattcttttcttacatctctatatgaagatacctgtgtccaaaatttttgaagatatatattgtatgtgtttattcttcatatggtactttaccatatttatatattgttttatacctgtaggtttacacacaagtaaatcttttttttcttgaatttaatctgggcactttgcactgccacagnggtgacgatggaactatgtatatagttaggatgttttgatttcggtaaaaaatatatgtccatcgtttgctatcaccagtacctctcagcttactcttcaggggatatgaaacaatctgtagattggtttccatacagggaagttctctgtcctatgcaatgtttctaattaatttgcttagttctgagccatttattctgctacactttgaaagatatattagttctgacttattgtttggggctttattttatttttatttttttgagatggagtttcactcttgttgcccaggctggagtgcaatagctcgatctcggctcactgcaacctcgcctccctggttcaagcaattctcctgcctcagcgattacaggaatgcaccaccacgcccagctaattttgtagagatggggtttctccatgttggtcaggctggtctcaaactcctgacctcaggtgatccgcccacctcggccttgcaaaatgctgggattacaggcatgagccaccatgcccagccatgtttggggctttattttataagttagaactttgaagaggaaatggtgctatatgtttattgttattactttgtgtaactttgatgtaatgtttataagctatgagaatcagttataaaagtattagccatttgttgtaaatgccaataaaatattcaccaggggcaagaatgtacattttctttttagaaaaccaaatgtactttagacatgaatgcaactatttaaagaatagcttcatttatgttattccttacatgtcataagattcttacttaaacttggtcttctttcaagttgtttgtatgaagatgctgtacccacttgaacagtcctcaggtgtttacataaatactatgttttacagttttcatattttaaaatattaataaagttaatcgcaacgattcaat

SEQ ID NO: 344077 - DNA, 409 bp, Homo sapiens
tggtgtcgcctgacaggagatgtattacaacccccaggaactagtggtaagataataattaactactttttcttctactttattgaagttagatgtaactgtcattggtggcattgtgattagcgttggtggtaccaggtggtacatgccccaactggtggcagacagaacaaagcgctgtccaggctagagaactggaggtaaaggaaagctatgattagaattcttgaggtcactgcagcatcatagtctgagttccagtccacactggagattatggacaaagctaaaagtcatatttggaccattgaggtcttgttgctataagcaaggggggtggtatgtactcagctccttttatagttgatattcaattaaaaattatacatggtattccattgttcatatc

SEQ ID NO: 344078 - DNA, 349 bp, Homo sapiens
tcttaaattcctggtacatagtagataatacatatttcttgaatgaatgaacccggctggttttgtttctttccaggttcttgactctgctccagagaaaatatgagatgttggagagcagagtttcagatctgtgagaactgttgtcttcctgtattaattgataattaaacatggagcttaatttttggttgctaagggttgtgagagaatacgcaacttttcacttcgagcacatgagtcttaatacatcttaacaatgaaatcttttttttttttaatgttttgataggaaccaccaaagcccccactaaataattttaaagtggggatgaaactggaagctatt

SEQ ID NO: 344079 - DNA, 4416 bp, Homo sapiens
cttgcttgaagatgcagagcgatgcagacacaagatgcagacagcttccacgctcatcagtggcttggcaggtgaaaaagaaagatggacagagcaaagccaagagtttgctgcacaaactaaaagacttgtaggggatgtactgttggctacagcttttctatcttattctggtccatttaaccaagagtttcgtgatcttctgttaaatgactggcggaaggaaatgaaagcccggaaaattccatttggaaagaacctaaatctcagtgagatgttgattgatgctcctactattagtgaatggaacctccaaggtctgccaaatgatgacttgtccattcaaaatggaattattgtcacgaaggcatctcgttaccctttgttaattgatccacagactcaaggcaagatctggattaaaaataaagaaagccgaaatgaactccagatcacgtctttaaatcacaagtacttcagaaaccacctggaagacagcctttctcttggaaggcctttgcttattgaagatgttggagaggaactagatccagcactagataatgttttggaaagaaacttcattaaaactgggtctacctttaaggtgaaagttggtgacaaggaagtagatgtgttggatggctttagactctacattaccaccaaattgcctaacccagcctacacccctgagataagtgcccgtacctccatcattgacttcactgtcaccatgaaaggtctagaagatcagttactggggagggtcattctcacagagaagcaggaattggagaaagaaagaactcatctgatggaagatgtaactgcaaacaaaagaaggatgaaggaactagaagataacttgctttaccgcctgacaagtacccaggggtccctggtagaagatgaaagtctcattgtcgtgctgagtaacacaaaaaggacagccgaggaggtgacacagaagctagaaatttctgctgagacagaagttcaaattaactcagcccgggaggaatacagacctgtggctacgcggggcagcatcctctacttcctcattactgagatgcgcttggttaatgagatgtatcagacttcgcttcgccagtttctgggcttatttgacctttccttagccaggtctgtcaagagcccgattacaagcaagaggattgctaatatcatcgagcacatgacctacgaggtttataagtatgctgcccgagggctgtacgaggagcacaaattcctgttcaccttgttgcttaccctaaagattgacatccagaggaaccgagtcaagcatgaagagtttctcactcttattaaaggaggtgcctcattagaccttaaagcttgtcctccaaaaccatcaaaatggatcctggacataacatggctgaatttggtggaacttagcaaactcagacagttttcagatgtccttgaccagatatcgagaaatgagaaaatgtggaaaatttggtttgataaggaaaacccggaggaggaacctcttccaaatgcctatgataaatctcttgactgcttcagacgtcttctccttattagatcctggtgtcctgacagaaccatcgcccaggcccgcaagtacatcgtggactccatgggagaaaaatatgccgaaggtgttattttagacttggagaagacgtgggaggaatctgatccacggacgccactcatctgtctcctgtctatgggctcagaccccacagattccatcattgccttggggaagagattaaaaatagaaacccgttatgtgtccatgggccagggccaggaagtccatgctcggaagctcttgcagcagaccatggcgaacggaggatgggcacttctgcagaactgccatctgggacttgatttcatggatgagctgatggacataatcatagaaactgagcttgtacatgatgcgttccgcctctggatgaccaccgaggttcataagcagtttcccattacactccttcagatgtccattaaatttgccaacgatcctccacaaggcctccgggcaggactgaaaagaacatatagtggtgtcagccaagacctgctggacgtgagctctgggtcccagtggaagcccatgctgtacgcagtggctttcctgcactccactgtccaggagaggcgcaagttcggtgccctggggtggaatatcccctacgaatttaaccaagcggactttaatgccactgtgcagttcatccaaaaccacttggatgacatggatgtcaaaaagggtgtctcctggaccaccatccgctacatgataggagagattcaatatggaggcagagtcactgacgactatgataagagattgttgaacacatttgctaaggtttggttcagtgaaaatatgtttggaccagatttcagtttttaccaaggatacaatattccaaaatgcagcacagtggataactatcttcagtatatccagagtttgcctgcctatgacagccctgaggtgtttgggctgcaccccaatgctgacatcacctaccagagcaagctggccaaggacgtgctggacaccatcctaggcatccaacccaaggacacctctggtggaggggatgagacccgggaggcggtggtggcccggctggctgatgatatgctggagaagctgcccccagactatgtcccctttgaagtaaaagagaggctgcagaagatggggccattccagcctatgaacattttcctcaggcaggaaatagacagaatgcaaagggtactcagccttgtccgcagcaccctcactgagctgaaacttgctattgatggcaccatcatcatgagcgaaaatctgcgagatgcattggattgcatgtttgatgctagaatccctgcttggtggaaaaaagcttcttgggtttctagtacactgggtttctggtttactgaacttatagaaagaaacagccagtttacctcgtgggttttcaatggccgacctcactgcttttggatgacgggtttttttaacccccagggatttttaactgcaatgcgacaggaaataactcgggccaacaaaggctgggctctggacaatatggtgctttgcaatgaagtcaccaaatggatgaaggacgacatttctgcccctcccacagagggtgtctatgtctatggcttatatcttgaaggtgctggctgggacaagaggaacatgaaactcattgaatcaaagccaaaagtgctctttgagttgatgcctgtcataaggatttatgcagaaaacaatactttacgagatcctcggttttactcctgtcccatctataagaagccagttcgaacggacttgaactacattgccgctgtggatctcaggacagcccagacccctgaacactgggtgctccgtggggttgcccttctgtgtgatgtcaagtaacatgtggggagtgtccccacccaatgctttggaaaatgcaagatctaaattattgtaacctttatttctgtatgactgctggacagtgtatgttaggtcgtttatgcaattaatgagctgcataggttttccccactccttaattggatgcttatattttacttgtttcatcattagtgaccaatgtctgagtttgttgaaaatgttatttagtgatataaaagtaaatttacagcatcctaatgaagtgtggccctcaaatccacagtagtatattttcttcttacttcgctccgaagactgaactgtgattataacagcaaatatatttgcatgtggacaaagattagatggcaagatagaaaaataagaacagatgtgatagcaagaattatagttggcttgaaaaaatgtgatgatcaggagaaaaaataaaaaaagggtagaaatattagacggtgcgtagggactttctatggacttttattaattaggaaacattatcaaaggaacttttcacgtatttttctttaaattctggttagatgttattaataattcttcatctaacctactgactagaaaatatagtcagtactaaattagaattgtggtttataaacttttggttagctctggatctgtataactgcatttttttggataaacagtttttggtaggtggataccgggagacaagtgtgggtccctctcactgggcttcattctgtggaccaggatcattatttcatgctcatgatcatgagagttaggactgagtggctcctgtgactcccaccatcttagatgatactgttttcttgtgagttctttcttttggtgtggattagtatatcagttgatttgtgtgaattgtggtgaaacaatcatttcattttgaaaagcaagtaatgaaaatgtcaacatcataggaattaataaaatgtttttactaaatgcct

SEQ ID NO: 344080 - DNA, 5115 bp, Homo sapiens
cttgcttgaagatgcagagcgatgcagacacaagatgcagacagcttccacgctcatcagtggcttggcaggtgaaaaagaaagatggacagagcaaagccaagagtttgctgcacaaactaaaagacttgtaggggatgtactgttggctacagcttttctatcttattctggtccatttaaccaagagtttcgtgatcttctgttaaatgactggcggaaggaaatgaaagcccggaaaattccatttggaaagaacctaaatctcagtgagatgttgattgatgctcctactattagtgaatggaacctccaaggtctgccaaatgatgacttgtccattcaaaatggaattattgtcacgaaggcatctcgttaccctttgttaattgatccacagactcaaggcaagatctggattaaaaataaagaaagccgaaatgaactccagatcacgtctttaaatcacaagtacttcagaaaccacctggaagacagcctttctcttggaaggcctttgcttattgaagatgttggagaggaactagatccagcactagataatgttttggaaagaaacttcattaaaactgggtctacctttaaggtgaaagttggtgacaaggaagtagatgtgttggatggctttagactctacattaccaccaaattgcctaacccagcctacacccctgagataagtgcccgtacctccatcattgacttcactgtcaccatgaaaggtctagaagatcagttactggggagggtcattctcacagagaagcaggaattggagaaagaaagaactcatctgatggaagatgtaactgcaaacaaaagaaggatgaaggaactagaagataacttgctttaccgcctgacaagtacccaggggtccctggtagaagatgaaagtctcattgtcgtgctgagtaacacaaaaaggacagccgaggaggtgacacagaagctagaaatttctgctgagacagaagttcaaattaactcagcccgggaggaatacagacctgtggctacgcggggcagcatcctctacttcctcattactgagatgcgcttggttaatgagatgtatcagacttcgcttcgccagtttctgggcttatttgacctttccttagccaggtctgtcaagagcccgattacaagcaagaggattgctaatatcatcgagcacatgacctacgaggtttataagtatgctgcccgagggctgtacgaggagcacaaattcctgttcaccttgttgcttaccctaaagattgacatccagaggaaccgagtcaagcatgaagagtttctcactcttattaaaggaggtgcctcattagaccttaaagcttgtcctccaaaaccatcaaaatggatcctggacataacatggctgaatttggtggaacttagcaaactcagacagttttcagatgtccttgaccagatatcgagaaatgagaaaatgtggaaaatttggtttgataaggaaaacccggaggaggaacctcttccaaatgcctatgataaatctcttgactgcttcagacgtcttctccttattagatcctggtgtcctgacagaaccatcgcccaggcccgcaagtacatcgtggactccatgggagaaaaatatgccgaaggtgttattttagacttggagaagacgtgggaggaatctgatccacggacgccactcatctgtctcctgtctatgggctcagaccccacagattccatcattgccttggggaagagattaaaaatagaaacccgttatgtgtccatgggccagggccaggaagtccatgctcggaagctcttgcagcagaccatggcgaacggaggatgggcacttctgcagaactgccatctgggacttgatttcatggatgagctgatggacataatcatagaaactgagcttgtacatgatgcgttccgcctctggatgaccaccgaggttcataagcagtttcccattacactccttcagatgtccattaaatttgccaacgatcctccacaaggcctccgggcaggactgaaaagaacatatagtggtgtcagccaagacctgctggacgtgagctctgggtcccagtggaagcccatgctgtacgcagtggctttcctgcactccactgtccaggagaggcgcaagttcggtgccctggggtggaatatcccctacgaatttaaccaagcggactttaatgccactgtgcagttcatccaaaaccacttggatgacatggatgtcaaaaagggtgtctcctggaccaccatccgctacatgataggagagattcaatatggaggcagagtcactgacgactatgataagagattgttgaacacatttgctaaggtttggttcagtgaaaatatgtttggaccagatttcagtttttaccaaggatacaatattccaaaatgcagcacagtggataactatcttcagtatatccagagtttgcctgcctatgacagccctgaggtgtttgggctgcaccccaatgctgacatcacctaccagagcaagctggccaaggacgtgctggacaccatcctaggcatccaacccaaggacacctctggtggaggggatgagacccgggaggcggtggtggcccggctggctgatgatatgctggagaagctgcccccagactatgtcccctttgaagtaaaagagaggctgcagaagatggggccattccagcctatgaacattttcctcaggcaggaaatagacagaatgcaaagggtactcagccttgtccgcagcaccctcactgagctgaaacttgctattgatggcaccatcatcatgagcgaaaatctgcgagatgcattggattgcatgtttgatgctagaatccctgcttggtggaaaaaagcttcttgggtttctagtacactgggtttctggtttactgaacttatagaaagaaacagccagtttacctcgtgggttttcaatggccgacctcactgcttttggatgacgggtttttttaacccccagggatttttaactgcaatgcgacaggaaataactcgggccaacaaaggctgggctctggacaatatggtgctttgcaatgaagtcaccaaatggatgaaggacgacatttctgcccctcccacagagggtgtctatgtctatggcttatatcttgaaggtgctggctgggacaagaggaacatgaaactcattgaatcaaagccaaaagtgctctttgagttgatgcctgtcataaggatttatgcagaaaacaatactttacgagatcctcggttttactcctgtcccatctataagaagccagttcgaacggacttgaactacattgccgctgtggatctcaggacagcccagacccctgaacactgggtgctccgtggggttgcccttctgtgtgatgtcaagtaacatgtggggagtgtccccacccaatgctttggaaaatgcaagatctaaattattgtaacctttatttctgtatgactgctggacagtgtatgttaggtcgtttatgcaattaatgagctgcataggttttccccactccttaattggatgcttatattttacttgtttcatcattagtgaccaatgtctgagtttgttgaaaatgttatttagtgatataaaagtaaatttacagcatcctaatgaagtgtggccctcaaatccacagtagtatattttcttcttacttcgctccgaagactgactagggtaagcagacagtatttctctgggaggaattattcttctgttaacgtggcctggtaacagccaagttcttgaaggtaacagggcaagtctgtgctgattttgcttctattgcctttcgtatttaggtcaagttaagagacttattttcagggtttcaagcagccaattaaaaataccttttaaaaaatagaaggaaatagaagaatggattaagaatgtaaatagaaaatttatgtaaacatagagaataaacgtagaacaatgcttaagcctacttataattaataatgaaatactaattgataattcttataataaaaattaaagctaaaagtaaatgatagcatgctctcagtaaaactgatccactcacaaattgctggagcaatgtaaatcaacccaacctttttgtaaaatgattaaatacagaaagagccataaaaatattcacacccttggatctttgttttctctacatcaaggaaacaatttaaaagactgaaaacagtctatataaaattgcatttaataacagaaaaaaatggaaaaatcataaatattcaatagtcaggctatggttaaggaaattaagagatatttggcaaccataaaaaacaattttgaagattccataatatgaaatggtagacccagactgttaagtgaaagatttagtttacaaaatattgagcacactgtgattataacagcaaatatatttgcatgtggacaaagattagatggcaagatagaaaaataagaacagatgtgatagcaagaattatagttggcttgaaaaaatgtgatgatcaggagaaaaaataaaaaaagggtagaaatattagacggtgcgtagggactttctatggacttttattaattaggaaacattatcaaaggaacttttcacgtatttttctttaaattctggttagatgttattaataattcttcatctaacctactgactagaaaatatagtcagtactaaattagaattgtggtttataaacttttggttagctctggatctgtataactgcatttttttggataaacagtttttggtaggtggataccgggagacaagtgtgggtccctctcactgggcttcattctgtggaccaggatcattatttcatgctcatgatcatgagagttaggactgagtggctcctgtgactcccaccatcttagatgatactgttttcttgtgagttctttcttttggtgtggattagtatatcagttgatttgtgtgaattgtggtgaaacaatcatttcattttgaaaagcaagtaatgaaaatgtcaacatcataggaattaataaaatgtttttactaaatgcct

SEQ ID NO: 344081 - DNA, 266 bp, Homo sapiens
atgacttaaatgttcatttttttctgtatagatactttatcatgttttcatgattttaggaattactgctttgttgatattcaaagtgtaaaactaaaactttatggttgtactttaattcttggcatgttgcctctatgtcccatttaaaataaaatacattctcattaactttagatgggaaataaggttgtatgttgatggatgaattttggcatgatgactgtactctcaataaaggctgaaaatgttgtataaaaacaaaa

SEQ ID NO: 344082 - DNA, 142 bp, Homo sapiens
ctggagcatgccagcaagtaaaaataaacctggaagagcactgggttcaagcccacgttccgtccatcccagagggccctcgagcaaggcctcctgcccaatcacatgtttttatcataatagattcttccaggtggtaaga

SEQ ID NO: 344083 - DNA, 543 bp, Homo sapiens
agaatcattcttatgctcttgattttttattttaatgacacacagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggtaatacaattttaaagttgtattgttttctttgttcattattaacattattcagagtaggaatttaattgtaaaccatattgcatatattttttaaaatagtacataccacctaatactatgattatttttatatttaacattctgctacttatatatgatagtgagttagaaattagacaacaaaggaactttttggatgctttctttctcaccgctgtctcctgcctagcttttaaattaggaattaga

SEQ ID NO: 344084 - DNA, 567 bp, Homo sapiens
  misc_feature (455)..(455): n is a, c, g, or t
  misc_feature (499)..(499): n is a, c, g, or t
ccgtcgtaactccgtaccatttatcttcaatacacatcaccttcttgaatatagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcantggataatgttgaacatgcttttgctgttcagcaactaaggaanagtgggaaaaatgcaaaaattacaattagaaggaagaagaaggttcaaataccagtaagtcgtcctga

SEQ ID NO: 344085 - DNA, 291 bp, Homo sapiens
atgcctcggtactgggcaggcaatgataccacccactttgctacagtgataacagaccctgtgacaagataatgggaagtgtctctaatattaactgtgaattttggtatttcagtgtgctgaattgttggatgttcttgctcaccttattaaggacattttcttaaaaggtaaatgatttgtttttcttttcctttatcagagcacagcaatggaggaaacagctatatgggaacaacatacagtgacgcttcacagggtaagtttgtgttgcagtaagtaatctgtgta

SEQ ID NO: 344086 - DNA, 8501 bp, Homo sapiens
cagtcggcgccggtgaacgagagcaacgcttctgaccctgccggagctcctcggagatgaaagccatgacgcgccttgcagaaaatgcattccgccttccgtgggaacaacgccgaggcacgcggtgacagccgtgaccatgctgtttgcccagtgaaggaaacaactgtcgggtatcggctctgccggcctttccagccgcactcatgcatggggctcaccccatgatgtgcgtggcttgtcgaggagcaagtggacaagtctcttaaggaaagctttggtgcacaggcgctttctccttgggggcgaattctgccagaccttggataaaaacaaacaggaagactcgcacggcagcggaaactgtcttccaagttacttgggttacccggcttttccttccgcgcttggggtcgggaccccggccgctcgtcccgccccctccccgcctcgcctcgcctcgcctcgtccagccccgcccccgccgggccgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgctgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgctgccagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttcttttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 344087 - DNA, 8261 bp, Homo sapiens
cagtcggcgccggtgaacgagagcaacgcttctgaccctgccggagctcctcggagatgaaagccatgacgcgccttgcagaaaatgcattccgccttccgtgggaacaacgccgaggcacgcggtgacagccgtgaccatgctgtttgcccagtgaaggaaacaactgtcgggtatcggctctgccggcctttccagccgcactcatgcatggggctcaccccatgatgtgcgtggcttgtcgaggagcaagtggacaagtctcttaaggaaagctttggtgcacaggcgctttctccttgggggcgaattctgccagaccttggataaaaacaaacaggaagactcgcacggcagcggaaactgtcttccaagttacttgggttacccggcttttccttccgcgcttggggtcgggaccccggccgctcgtcccgccccctccccgcctcgcctcgcctcgcctcgtccagccccgcccccgccgggccgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgctgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgctgccagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttcttttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 344088 - DNA, 6910 bp, Homo sapiens
cgcgctagacggctaacgggcagcatggatgaactctgggagttgatacacaaggaggaacaaacacttccacaggacttctgaatccctcaagcaggtaggagattccatatgaagcagggcttcagcagcttcaatggtcttatctgtacagtgtgcattactgctgtgaactgatgcttccacggcccggatgagcagatccagctggttcgtgggtccctcatgcagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgctgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgctgccagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttcttttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 344089 - DNA, 5667 bp, Homo sapiens
gctacacaaactaagttacctatgacgtctatgaaagagtggacttcgagaagctcgcattctgcggctgtaagcgatagtggaaccagttatgctcaggttgccagagaaaagctgacaggcacagaccagatattttcacatgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgctgccagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttcttttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 344090 - DNA, 5578 bp, Homo sapiens
tgattacgaatttcggagccccggaaccccttggcaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgctgccagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttcttttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 344091 - DNA, 3721 bp, Homo sapiens
gagctcggccccattgtcatcatagcgcaggaaggatgtaaatagacacggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgctgccagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttcttttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 344092 - DNA, 2486 bp, Homo sapiens
gatctgctttgaaatacagcaatgtgttttgatacaaattcaatatgctgaagaaacagaagaaaattatgtctaaatatacgtatttgccctataattgcaaagcattacggatagcagtttactgaactgtaaatgacatcaacttcttttctctcataggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttcttttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 344093 - DNA, 6330 bp, Homo sapiens
cagtcggcgccggtgaacgagagcaacgcttctgaccctgccggagctcctcggagatgaaagccatgacgcgccttgcagaaaatgcattccgccttccgtgggaacaacgccgaggcacgcggtgacagccgtgaccatgctgtttgcccagtgaaggaaacaactgtcgggtatcggctctgccggcctttccagccgcactcatgcatggggctcaccccatgatgtgcgtggcttgtcgaggagcaagtggacaagtctcttaaggaaagctttggtgcacaggcgctttctccttgggggcgaattctgccagaccttggataaaaacaaacaggaagactcgcacggcagcggaaactgtcttccaagttacttgggttacccggcttttccttccgcgcttggggtcgggaccccggccgctcgtcccgccccctccccgcctcgcctcgcctcgcctcgtccagccccgcccccgccgggccgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgctgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgctgccagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatgga

SEQ ID NO: 344094 - DNA, 6291 bp, Homo sapiens
cagtcggcgccggtgaacgagagcaacgcttctgaccctgccggagctcctcggagatgaaagccatgacgcgccttgcagaaaatgcattccgccttccgtgggaacaacgccgaggcacgcggtgacagccgtgaccatgctgtttgcccagtgaaggaaacaactgtcgggtatcggctctgccggcctttccagccgcactcatgcatggggctcaccccatgatgtgcgtggcttgtcgaggagcaagtggacaagtctcttaaggaaagctttggtgcacaggcgctttctccttgggggcgaattctgccagaccttggataaaaacaaacaggaagactcgcacggcagcggaaactgtcttccaagttacttgggttacccggcttttccttccgcgcttggggtcgggaccccggccgctcgtcccgccccctccccgcctcgcctcgcctcgcctcgtccagccccgcccccgccgggccgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgctgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgctgccagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatgga

SEQ ID NO: 344095 - DNA, 2473 bp, Homo sapiens
cagtcggcgccggtgaacgagagcaacgcttctgaccctgccggagctcctcggagatgaaagccatgacgcgccttgcagaaaatgcattccgccttccgtgggaacaacgccgaggcacgcggtgacagccgtgaccatgctgtttgcccagtgaaggaaacaactgtcgggtatcggctctgccggcctttccagccgcactcatgcatggggctcaccccatgatgtgcgtggcttgtcgaggagcaagtggacaagtctcttaaggaaagctttggtgcacaggcgctttctccttgggggcgaattctgccagaccttggataaaaacaaacaggaagactcgcacggcagcggaaactgtcttccaagttacttgggttacccggcttttccttccgcgcttggggtcgggaccccggccgctcgtcccgccccctccccgcctcgcctcgcctcgcctcgtccagccccgcccccgccgggccgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggtaatacaattttaaagttgtattgttttctttgttcattattaacattattcagagtaggaatttaattgtaaaccatattgcatatattttttaaaatagtacataccacctaatactatgattatttttatatttaacattctgctacttatatatgatagtgagttagaaattagacaacaaaggaactttttggatgctttctttctcaccgctgtctcctgcctagcttttaaattaggaattaga

SEQ ID NO: 344096 - DNA, 1631 bp, Homo sapiens
  misc_feature (1519)..(1519): n is a, c, g, or t
  misc_feature (1563)..(1563): n is a, c, g, or t
cagtcggcgccggtgaacgagagcaacgcttctgaccctgccggagctcctcggagatgaaagccatgacgcgccttgcagaaaatgcattccgccttccgtgggaacaacgccgaggcacgcggtgacagccgtgaccatgctgtttgcccagtgaaggaaacaactgtcgggtatcggctctgccggcctttccagccgcactcatgcatggggctcaccccatgatgtgcgtggcttgtcgaggagcaagtggacaagtctcttaaggaaagctttggtgcacaggcgctttctccttgggggcgaattctgccagaccttggataaaaacaaacaggaagactcgcacggcagcggaaactgtcttccaagttacttgggttacccggcttttccttccgcgcttggggtcgggaccccggccgctcgtcccgccccctccccgcctcgcctcgcctcgcctcgtccagccccgcccccgccgggccgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggaccagctgaaggacagctacaggaaaatgaccgagttgcaatggttaacggagtttcantggataatgttgaacatgcttttgctgttcagcaactaaggaanagtgggaaaaatgcaaaaattacaattagaaggaagaagaaggttcaaataccagtaagtcgtcctga

SEQ ID NO: 344097 - DNA, 397 bp, Homo sapiens
tccttaaatgtgaattttttatacaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcaga

SEQ ID NO: 344098 - DNA, 8666 bp, Homo sapiens
tccgggtatggatgtcaatcttttgtctacaatgtgaatacatttatccttcggggaccatcaagactttcaggaaaggccccgcctgtctctgcgcggccactttgctgggacaaaggtcaactgaagaagtgggcaggcccgaggcaggagagatgctgaggagtccatgtgcaggggagggaaagggagaggcagtcagggagaggaggaggaggtaccgccagaaggggatcctcccgctccgaaaaccagacaccgggtcttgccctgtggtccaggcaggagtgcagtggtgcaacctcagctcactgcagccttgacctccccgggctcaagcgatcctccggccacagcacttggctgttcagcggctggaggagcagggccccaggtcctccccaccctcacctgctgctcccaggtcgtggccgtcttgctcttccaggtccttctctagggatgcaatattcacattgctaagatgcaggtctaacgcagaacctgtcaacagagccccccatcatccacagcccacccagcgctgcagagctcaggaagcctagctgaggaggacgaccgtcccacctgggcttagagtgagaccaagggcagaaggcgtgggagttgctggggcagccagggaaggacacccccagcccgtcctcgcagccccccacaggcagtgggaggcttggctgttcctccggcaaaacgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgctgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgctgccagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttcttttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 344099 - DNA, 8462 bp, Homo sapiens
cagtcggcgccggtgaacgagagcaacgcttctgaccctgccggagctcctcggagatgaaagccatgacgcgccttgcagaaaatgcattccgccttccgtgggaacaacgccgaggcacgcggtgacagccgtgaccatgctgtttgcccagtgaaggaaacaactgtcgggtatcggctctgccggcctttccagccgcactcatgcatggggctcaccccatgatgtgcgtggcttgtcgaggagcaagtggacaagtctcttaaggaaagctttggtgcacaggcgctttctccttgggggcgaattctgccagaccttggataaaaacaaacaggaagactcgcacggcagcggaaactgtcttccaagttacttgggttacccggcttttccttccgcgcttggggtcgggaccccggccgctcgtcccgccccctccccgcctcgcctcgcctcgcctcgtccagccccgcccccgccgggccgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgctgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgctgccagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttcttttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 344100 - DNA, 8390 bp, Homo sapiens
cagtcggcgccggtgaacgagagcaacgcttctgaccctgccggagctcctcggagatgaaagccatgacgcgccttgcagaaaatgcattccgccttccgtgggaacaacgccgaggcacgcggtgacagccgtgaccatgctgtttgcccagtgaaggaaacaactgtcgggtatcggctctgccggcctttccagccgcactcatgcatggggctcaccccatgatgtgcgtggcttgtcgaggagcaagtggacaagtctcttaaggaaagctttggtgcacaggcgctttctccttgggggcgaattctgccagaccttggataaaaacaaacaggaagactcgcacggcagcggaaactgtcttccaagttacttgggttacccggcttttccttccgcgcttggggtcgggaccccggccgctcgtcccgccccctccccgcctcgcctcgcctcgcctcgtccagccccgcccccgccgggccgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgctgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgctgccagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacgctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttcttttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 344101 - DNA, 4210 bp, Homo sapiens
cggccgcagctctggcggacatcttgtctctctccagcgccgcgcgaggctcctcggacccgaaactccgcggcgctggcccgcccgctcctcacgccacagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgctgccagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttcttttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 344102 - DNA, 2171 bp, Homo sapiens
gttttttggcagtttttacatttatttaaacagaaaacgtgcacatgagctgcctactcattttcttcactgcgcagcctggcattggggttggtgactctgatggccagttgggcagctctttccacgatggctttgcggttcttggaggaaacattgtgagcgatctcggcacagtaagatttgttgcacatcagcagcacttccagctccttgacgttgtggaccaggaacttccggaagccactgggcagcatgtgctttgtttttttgttgcttccataaccaatgttgggcatcaagatctggcccttgaatcttctacgaaccctgttgtcaatgcctctgggtttccgccagttacgcttaattttgacatatcggtctgactggtgccggatgaacttcttggttctctttttgacgatcttgggcttcctcggcgctgctacggaggtggcagccaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttcttttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 344103 - DNA, 6270 bp, Homo sapiens
cagtcggcgccggtgaacgagagcaacgcttctgaccctgccggagctcctcggagatgaaagccatgacgcgccttgcagaaaatgcattccgccttccgtgggaacaacgccgaggcacgcggtgacagccgtgaccatgctgtttgcccagtgaaggaaacaactgtcgggtatcggctctgccggcctttccagccgcactcatgcatggggctcaccccatgatgtgcgtggcttgtcgaggagcaagtggacaagtctcttaaggaaagctttggtgcacaggcgctttctccttgggggcgaattctgccagaccttggataaaaacaaacaggaagactcgcacggcagcggaaactgtcttccaagttacttgggttacccggcttttccttccgcgcttggggtcgggaccccggccgctcgtcccgccccctccccgcctcgcctcgcctcgcctcgtccagccccgcccccgccgggccgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgctgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgctgccagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatgga

SEQ ID NO: 344104 - DNA, 6093 bp, Homo sapiens
cagtcggcgccggtgaacgagagcaacgcttctgaccctgccggagctcctcggagatgaaagccatgacgcgccttgcagaaaatgcattccgccttccgtgggaacaacgccgaggcacgcggtgacagccgtgaccatgctgtttgcccagtgaaggaaacaactgtcgggtatcggctctgccggcctttccagccgcactcatgcatggggctcaccccatgatgtgcgtggcttgtcgaggagcaagtggacaagtctcttaaggaaagctttggtgcacaggcgctttctccttgggggcgaattctgccagaccttggataaaaacaaacaggaagactcgcacggcagcggaaactgtcttccaagttacttgggttacccggcttttccttccgcgcttggggtcgggaccccggccgctcgtcccgccccctccccgcctcgcctcgcctcgcctcgtccagccccgcccccgccgggccgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgctgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgctgccagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtaaatgtgtttatttttctccttagttttgataacttaagagttgccctgtgtgcactt

SEQ ID NO: 344105 - DNA, 399 bp, Homo sapiens
acttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacaggtaagcagcaagcattcaacgttttgtagatagaggtgcattattaaattttagaatgtggtgattgagttaaaaatatatatgttgtcctttctccagattaagaattaatcttcaatttcaatttgagagtaccaagggcttaattctaaa

SEQ ID NO: 344106 - DNA, 414 bp, Homo sapiens
tactgattaaagtttaataaaagcattaaacttaattattttaagtaaatatgaagttgactgaattgaattgaaggaaaaattacttgaaaataattcaggttgttcacatccaaatcaatacgttccatgatgaaaaatttaaaatattaaggtctgataaatgacaagactaatgcctaagtataaatttacctaaatgacaacactgctaacagatgttatttaattgtcattttaaagagaaatccctaagcaattcacggtgctagtagagacaaagatgaaacacatgatcttgtttttgtaggatttcataattgatttggagtgggaaaataaaaaataactctagtaaaccctatgaaagaaggaaaaatcagaattaagggagcagagaggaagaaagatctt

SEQ ID NO: 344107 - DNA, 284 bp, Homo sapiens
gctaagctgcaagttcttgtctggagtcgaaggaccaataatatcgccttcacctgccccctcctggtccactcaccaggatgccaggcgggacttttgcaccaccctgactgtgaggcaatgccctggggatcctgctaagacacagctgctgacacggagacgggggtgcctgaggccctgcatttgtaacaagcttccaggcaatgcctgtaatcctggtcctcggtccagagtttgagaagcaaaaaaataaataatttatagggccccttgcctctcct

SEQ ID NO: 344108 - DNA, 283 bp, Homo sapiens
ggtggagcccaagagtttgagaccagcctgggcaacatagtgagacctctacaaaaactaaaaaataaaaaccagccaggcatggtggcacgtgcctgcagtcccagctacccaggaggaggatcgaggctgcagtgagctatgatcgtgccactgcactccagcttgggcaacagagcaagacctctcctcaaaacagaactccagcatggatacttacctggcaggggagataccgtgattacaaaactctagcatgggtgacagagcaaggccctgtctt

SEQ ID NO: 344109 - DNA, 432 bp, Homo sapiens
ggagtttgaggctgcagtgagccatgattgctccactgaactgcagcctaggtgacagagggagaccttgtctctaaagaaataaaaaataaaaataaaatacagtattgagaagctgagagcatggcatatatctgactgatttccattgtgatcacagagaagtgattcagccagacgtgatggaggaaatggtggtatcttgtgttattaagcacttgaacttggttgatgcactgcagtctctaataaatttccaatatcaagaagaacatgctgaagaatatgatttattatgtaaaattatgggagagacctttaagaaactcaatgccatggagagacagctgcagagtgttgcagaactggaacaaaaatggcaaagtgaagttgatgatgccatgcaggggaaactggagaacaacatgcctt

SEQ ID NO: 344110 - DNA, 384 bp, Homo sapiens
ggagtttgaggctgcagtgagccatgattgctccactgaactgcagcctaggtgacagagggagaccttgtctctaaagaaataaaaaataaaaataaaatacagtattgagaagctgagagcatggcatatatctgactgatttccattgtgatcacagagaagtgattcagccagacgtgatggaggaaatggtggtatcttgtgttattaagcacttgaacttggttgatgcactgcagtctctaataaatttccaatatcaagaagaacatgctgaagaatatgatttattatgtaaaattatgggagagacctttaagaaactcaatgccatggagagacagctgcaggtaaatgtctgataactgttggaaacaattt

SEQ ID NO: 344111 - DNA, 562 bp, Homo sapiens
tgagtgtgggcgtggtgctgggggtgcaggtgggcatgggtgtgtgcatgcaggcctggaggcggacagcagtcttcctgaggggtaggcatcttcttcattcagcgtctctccctacttttgctattcacattgaaggagcattatcagcgggttgttgacaagatgacaagtacccctgggaaatgatgactggcatttcattggctcaaagactgtactcaagtaaattactgcttgtttaacctcttttctccaatggccccaccccaactccatgcagaagtggcaggatgtgggtggcacaggggatgaggatggtaaaagccacaaggtgaccaggcaagagctgaggggctccacttcccaaagcagaagaaaaaaaagataaaacaacagaaaggagttcacttccttatccaagtctcattcattcatccatccatccacccatctagccaccaaacatccatcatcagctcaacccaaaagggcataattaaactttacttcctctctttcttcttcccagtcaatctaaaccttatcctaatcactgtag

SEQ ID NO: 344112 - DNA, 535 bp, Homo sapiens
tgtcatctcatactgtttcctctttgtgggaacagaagcagtttcttcagcctcagacctgagtgatgagggtcttggccagcacctagaccctcagagtaaggactcctaaggatcaaactgcagtgggcacctcttgtacccatctgtggtacccatggtcaagtccactgcaggaccaagttctgaccaccagagggcacttgcctactgtgttcatcccagaattaggctgtagaattcttgggaagctacatctttccagaggctgagactatgtcacggaactggcaaagaagggctcacccagatccttgaggcacttcaaggatagagcaggggtcattgcccaggtctcacttccacagggcacccctgctcttctagctggcctgtcacccagaagagccactggtcactctgggttttgttccagaggcaacttcttacatactggtgggtagacctccttagtgtaggctctgaggtttgctggtgaacaattccataggaagatctgcccggagaggacagg

SEQ ID NO: 344113 - DNA, 695 bp, Homo sapiens
gtttattcatgcagtgagctcattgtttctacagtcagaagatcaccagaaaaagatccatacctattttgtaacaagaattaggaaaccgaaatgactgagacatggtctctacttttgagacttttacaatgtagtgatctgagacagtgtgttcatttcagtgcaagccaatgctgcctattccgatcgctgctccctgatttgaatggcaggtgatcagtggcccgtgtggcttatggacacaccagagctcccaggggaagtgctctgaaaactcatcctggtcagagttcagaaggacacgtggagtataaggtcagatgcggagataaagggagatggtgtggccctcctgcctggggttgctgagcaggttgctggagacagtgatgtcactctgaaggagacagacacagaaacgtgtgtacagttgatggtgagcatctgagttgcgtcttgttagtgaggccaggagtgcctgtgtaagctggaacagattaggtatatgatttgtgaaacggagtttcatcctagatcttcatctagtcaaaggactgtttcctgattaggcattagcttagtggttgctagtctgtgttgacctttgaaaggcatgactaggctaactctgaagtttttgcttcacaccatttacaatttaaaattacctagagccttgtgggccattggaa

SEQ ID NO: 344114 - DNA, 422 bp, Homo sapiens
cgtccggccacccacacccgcgccgcggctggggcttgggttggggactgtggcggcgaagaagccggggagttctcacaagatctgatggtttaagcgtggcagtttcccctgagctctccttcctgctggtatgtaaggcgtgctttgcttcctcttcaccttccgccatgattgtacatttcctgaggcctccccagccatgcagaactgcatacaacttaggattcataactacatatatacggatagaagtgcatgaacagaaaatctgcccttctggaataccaaatgcaaaattaaagtgactacaagcagaatttggagaaaaaaataaaagatgcaatatagtttttaaaatcattgttaaaatataatgagtctgtactttgcttaaacaataaaaaagtcttcgatttata

SEQ ID NO: 344115 - DNA, 408 bp, Homo sapiens
  misc_feature (50)..(50): n is a, c, g, or t
tcacaaaagtcaatgtctcccccatcctcctataatcaaaaattctaggnagagagagttctcacaagatctgatggtttaagcgtggcagtttcccctgagctctccttcctgctggtatgtaaggcgtgctttgcttcctcttcaccttccgccatgattgtacatttcctgaggcctccccagccatgcagaactgcatacaacttaggattcataactacatatatacggatagaagtgcatgaacagaaaatctgcccttctggaataccaaatgcaaaattaaagtgactacaagcagaatttggagaaaaaaataaaagatgcaatatagtttttaaaatcattgttaaaatataatgagtctgtactttgcttaaacaataaaaaagtcttcgatttata

SEQ ID NO: 344116 - DNA, 285 bp, Homo sapiens
ggacggaaggcgtggaagcgggaggggccttcgtgtgaaaatcccttgtggggtttggtgtttcactttttaaaggcatacaacttaggattcataactacatatatacggatagaagtgcatgaacagaaaatctgcccttctggaataccaaatgcaaaattaaagtgactacaagcagaatttggagaaaaaaataaaagatgcaatatagtttttaaaatcattgttaaaatataatgagtctgtactttgcttaaacaataaaaaagtcttcgatttata

SEQ ID NO: 344117 - DNA, 376 bp, Homo sapiens
tggaaaaccttagaacaagaccagacttaattaacataaccagaaattatttcttccccagattttccttgtaggtggcagaatttctataccatgtatctttctacatccttctttggaaatgctggctttcccttttaactatcatatcctcataaccagatgatgtacttaaaaaaactggcctcctggcctcctttaaaactggttcttcttttgaactgccaacatatgcaactttgaaactcacaatgccattgcttgaaaatttaaccaactccagctcacataagtcctaaaatgatctcctaatcctcaataggattttcttttttcctcactccacttcccatgtattactgtacatcctccccca

SEQ ID NO: 344118 - DNA, 1653 bp, Homo sapiens
gcgcgcccgagccgggttatcatggcggctcccttggtcctggtgctggtggtggctgtgacagtgcgggcggccttgttccgctccagtctggccgagttcatttccgagcgggtggaggtggtgtccccactgagctcttggaagagagtggttgaaggcctttcactgttggacttgggagtatctccgtattctggagcagtatttcatgaaactccattaataatatacctctttcatttcctaattgactatgctgaattggtgtttatgataactgatgcactcactgctattgccctgtattttgcaatccaggacttcaataaagttgtgtttaaaaagcagaaactcctcctagaactggaccagtatgccccagatgtggccgaactcatccggacccctatggaaatgcgttacatccctttgaaagtggccctgttctatctcttaaatccttacacgattttgtcttgtgttgccaagtctacctgtgccatcaacaacaccctcattgctttcttcattttgactacgataaaaggcagtgctttcctcagtgctatttttcttgccttagcgacataccagtctctgtacccactcaccttgtttgtcccaggactcctctatctcctccagcggcagtacatacctgtgaaaatgaagagcaaagccttctggatcttttcttgggagtatgccatgatgtatgtgggaagcctagtggtaatcatttgcctctccttcttccttctcagctcttgggatttcatccccgcagtctatggctttatactttctgttccagatctcactccaaacattggtcttttctggtacttctttgcagagatgtttgagcacttcagcctcttctttgtatgtgtgtttcagatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttctatgccttcctgcggcgggagtactacctcacacatggcctctacttgaccgccaaggatggcacagaggccatgctcgtgctcaagtaggcctggctggcacagggctgcatggacctcagggggctgtggggccagaagctgggccaagccctccagccagagttgccagcaggcgagtgcttgggcagaagaggttcgagtccagggtcacaagtctctggtaccaaaagggacccatggctgactgacagcaaggcctatggggaagaactgggagctccccaacttggacccccaccttgtggctctgcacaccaaggagccccctcccagacaggaaggagaagaggcaggtgagcagggcttgttagattgtggctacttaataaatgttttttgttatgaagtcta

SEQ ID NO: 344119 - DNA, 1703 bp, Homo sapiens
gcgcgcccgagccgggttatcatggcggctcccttggtcctggtgctggtggtggctgtgacagtgcgggcggccttgttccgctccagtctggccgagttcatttccgagcgggtggaggtggtgtccccactgagctcttggaagagagtggttgaaggcctttcactgttggacttgggagtatctccgtattctggagcagtatttcatgaaactccattaataatatacctctttcatttcctaattgactatgctgaattggtgtttatgataactgatgcactcactgctattgccctgtattttgcaatccaggacttcaataaagttgtgtttaaaaagcagaaactcctcctagaactggaccagtatgccccagatgtggccgaactcatccggacccctatggaaatgcgttacatccctttgaaagtggccctgttctatctcttaaatccttacacgattttgtcttgtgttgccaagtctacctgtgccatcaacaacaccctcattgctttcttcattttgactacgataaaaggcagtgctttcctcagtgctatttttcttgccttagcgacataccagtctctgtacccactcaccttgtttgtcccaggactcctctatctcctccagcggcagtacatacctgtgaaaatgaagagcaaagccttctggatcttttcttgggagtatgccatgatgtatgtgggaagcctagtggtaatcatttgcctctccttcttccttctcagctcttgggatttcatccccgcagtctatggctttatactttctgttccagatctcactccaaacattggtcttttctggtacttctttgcagagatgtttgagcacttcagcctcttctttgtatgtgtgtttcagatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttctatgccttcctgcggcgggagtactacctcacacatggcctctacttgaccgccaaggatggcacagaggccatgctcgtgctcaagtaggcctggctggcacagggctgcatggacctcagggggctgtggggccagaagctgggccaagccctccagccagagttgccagcaggcgagtgcttgggcagaagaggttcgagtccagggtcacaagtctctggtaccaaaagggacccatggctgactgacagcaaggcctatggggaagaactgggagctccccaacttggacccccaccttgtggctctgcacaccaaggagccccctcccagacaggaaggagaagaggcaggtgagcagggcttgttagattgtggctacttaataaatgttttttgttatgaagtctaccctgagaccacatctgcattgcactcctagagggggtggcccctaataa

SEQ ID NO: 344120 - DNA, 1607 bp, Homo sapiens
gcgcgcccgagccgggttatcatggcggctcccttggtcctggtgctggtggtggctgtgacagtgcgggcggccttgttccgctccagtctggccgagttcatttccgagcgggtggaggtggtgtccccactgagctcttggaagagagtggttgaaggcctttcactgttggacttgggagtatctccgtattctggagcagtatttcatgaaactccattaataatatacctctttcatttcctaattgactatgctgaattggtgtttatgataactgatgcactcactgctattgccctgtattttgcaatccaggacttcaataaagttgtgtttaaaaagcagaaactcctcctagaactggaccagtatgccccagatgtggccgaactcatccggacccctatggaaatgcgttacatccctttgaaagtggccctgttctatctcttaaatccttacacgattttgtcttgtgttgccaagtctacctgtgccatcaacaacaccctcattgctttcttcattttgactacgataaaaggcagtgctttcctcagtgctatttttcttgccttagcgacataccagtctctgtacccactcaccttgtttgtcccaggactcctctatctcctccagcggcagtacatacctgtgaaaatgaagagcaaagccttctggatcttttcttgggagtatgccatgatgtatgtgggaagcctagtggtaatcatttgcctctccttcttccttctcagctcttgggatttcatccccgcagtctatggctttatactttctgttccagatctcactccaaacattggtcttttctggtacttctttgcagagatgtttgagcacttcagcctcttctttgtatgtgtgtttcagatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttctatgccttcctgcggcgggagtactacctcacacatggcctctacttgaccgccaaggatggcacagaggccatgctcgtgctcaagtaggcctggctggcacagggctgcatggacctcagggggctgtggggccagaagctgggccaagccctccagccagagttgccagcaggcgagtgcttgggcagaagaggttcgagtccagggtcacaagtctctggtaccaaaagggacccatggctgactgacagcaaggcctatggggaagaactgggagctcacctgcctcttctccttcctgtctgggagggggctccttggtgtgcagagcagcaaggtgggggtccaagttggggagcgtcgac

SEQ ID NO: 344121 - DNA, 1205 bp, Homo sapiens
gcgcgcccgagccgggttatcatggcggctcccttggtcctggtgctggtggtggctgtgacagtgcgggcggccttgttccgctccagtctggccgagttcatttccgagcgggtggaggtggtgtccccactgagctcttggaagagagtggttgaaggcctttcactgttggacttgggagtatctccgtattctggagcagtatttcatgaaactccattaataatatacctctttcatttcctaattgactatgctgaattggtgtttatgataactgatgcactcactgctattgccctgtattttgcaatccaggacttcaataaagttgtgtttaaaaagcagaaactcctcctagaactggaccagtatgccccagatgtggccgaactcatccggacccctatggaaatgcgttacatccctttgaaagtggccctgttctatctcttaaatccttacacgattttgtcttgtgttgccaagtctacctgtgccatcaacaacaccctcattgctttcttcattttgactacgataaaagcggcagtacatacctgtgaaaatgaagagcaaagccttctggatcttttcttgggagtatgccatgatgtatgtgggaagcctagtggtaatcatttgcctctccttcttccttctcagctcttgggatttcatccccgcagtctatggctttatggagcaccccatcttcttcatgtttatccagatcgctgtcatcgccatctttaagtcctacccgacagtgggggacgtggcgctctacatggccttcttccccgtgtggaaccatctctacagattggagaggagaaaaggaacgtggcccctccctgagtgtaggtcccagacgctggactctctggagcttggatgagtcatacagacgcacaattgtggtgttagggaacagcctgctggcagagcccatgccagcctgcatggtacagcagaaggagccagttaccaaagggctggatttgtgtgtgtgtttgttttgtttttattactattgtatagcgataaaagaatgttgatagatatacatataaagaatcatgataaaatatattcccacgtgttttggcacctcgtttaagaaagggaatatcaccatggcctttgaagtccccaaatcccccctgttccccttctgattggactggatttttcaggtg

SEQ ID NO: 344122 - DNA, 225 bp, Homo sapiens
ctacgttgaatatatttaatgtggctaggaattccatttaaacattagctgtcagcgctaacatgcatgctcccacattcacctttctgttttcctgtgcagtggagaggagaaaaggaacgtggcccctccctgagtgtaggtcccagacgctggactctctggagcttggatgagtcatacagacgcacaattgtggtgttagggaacagcctgctggcagag

SEQ ID NO: 344123 - DNA, 1808 bp, Homo sapiens
gcgcgcccgagccgggttatcatggcggctcccttggtcctggtgctggtggtggctgtgacagtgcgggcggccttgttccgctccagtctggccgagttcatttccgagcgggtggaggtggtgtccccactgagctcttggaagagagtggttgaaggcctttcactgttggacttgggagtatctccgtattctggagcagtatttcatgaaactccattaataatatacctctttcatttcctaattgactatgctgaattggtgtttatgataactgatgcactcactgctattgccctgtattttgcaatccaggacttcaataaagttgtgtttaaaaagcagaaactcctcctagaactggaccagtatgccccagatgtggccgaactcatccggacccctatggaaatgcgttacatccctttgaaagtggccctgttctatctcttaaatccttacacgattttgtcttgtgttgccaagtctacctgtgccatcaacaacaccctcattgctttcttcattttgactacgataaaaggcagtgctttcctcagtgctatttttcttgccttagcgacataccagtctctgtacccactcaccttgtttgtcccaggactcctctatctcctccaggtactgagcatcaataactgctgacatcagaaacaaaaaccaagcctcctgacaaaagaacattacccaccaccaaagtttgccaaaaggataaaatccaaaattgatcaagcctctggatatagctgcaatttgcaagaaatactgaaaacaagcggcagtacatacctgtgaaaatgaagagcaaagccttctggatcttttcttgggagtatgccatgatgtatgtgggaagcctagtggtaatcatttgcctctccttcttccttctcagctcttgggatttcatccccgcagtctatggctttatactttctgttccagatctcactccaaacattggtcttttctggtacttctttgcagagatgtttgagcacttcagcctcttctttgtatgtgtgtttcagatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttctatgccttcctgcggcgggagtactacctcacacatggcctctacttgaccgccaaggatggcacagaggccatgctcgtgctcaagtaggcctggctggcacagggctgcatggacctcagggggctgtggggccagaagctgggccaagccctccagccagagttgccagcaggcgagtgcttgggcagaagaggttcgagtccagggtcacaagtctctggtaccaaaagggacccatggctgactgacagcaaggcctatggggaagaactgggagctccccaacttggacccccaccttgtggctctgcacaccaaggagccccctcccagacaggaaggagaagaggcaggtgagcagggcttgttagattgtggctacttaataaatgttttttgttatgaagtcta

SEQ ID NO: 344124 - DNA, 762 bp, Homo sapiens
ggggagccattgactgaggagtctggggtttgcttcttggcaccccagtacctctgggggtgctctgcctttgagctacatgatgctcaccttgggcctctccattcaggggggccattgcagcagggaaagcatgccagagagagcgtgtcaggctaactgtaaccctctgtctttgcagtcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttctatgccttcctgcggcgggagtactacctcacacatggcctctacttgaccgccaaggatggcacagaggccatgctcgtgctcaagtaggcctggctggcacagggctgcatggacctcagggggctgtggggccagaagctgggccaagccctccagccagagttgccagcaggcgagtgcttgggcagaagaggttcgagtccagggtcacaagtctctggtaccaaaagggacccatggctgactgacagcaaggcctatggggaagaactgggagctccccaacttggacccccaccttgtggctctgcacaccaaggagccccctcccagacaggaaggagaagaggcaggtgagcagggcttgttagattgtggctacttaataaatgttttttgttatgaagtcta

SEQ ID NO: 344125 - DNA, 374 bp, Homo sapiens
tgattgtgatccagagccaggcaggggcgttcctgtcttccaacaacacctgccagcagttcagggatcctgggtttagggggaggtacccagcagcgcctcacaccctctctctccccccagatcctgctcatctctgattacttctatgccttcctgcggcgggagtactacctcacacatggcctctacttgaccgccaaggatggcacagaggccatgctcgtgctcaagtaggcctggctggcacagggctgcatggacctcagggggctgtggggccagaagctgggccaagccctccagccagagttgccagcaggcgagtgcttgggcagaagaggttcgagtccagggtcacaagtctctggtac

SEQ ID NO: 344126 - DNA, 223 bp, Homo sapiens
tgcatctttatttgggactctgatcagaaaaggagtcttagatagcctattatctaattttgagagtacatgaaaaataaattaggcattttctcagtatagtgaaatcatatttcaaatgatgcacctgcaagactagagttgatcgttgagcttacatataagcattcttctgtagaatttttagtaatcttaatggcaatccacaatgatgaattgaagc

SEQ ID NO: 344127 - DNA, 338 bp, Homo sapiens
ggatatccgattcatgtaatgtaataccagctaatttttgtatttttggtagagaaggtgtttcaccatgttggccaggctggtcttgaactctggacctcaagtggtcctcctgccttggactcccaaaatgttaagattacaggcatgaaccactgcctccggtccagaatgattttgtcagaagaagccatttgagctaaagcgtagagatgggataaacctggaatacttggaggaacttggagcagttgagaaggctggagagtgtggacctgaggaaggaggtgggagaagggaattaaggaattaaggtggaattaaggaattgaggaaag

SEQ ID NO: 344128 - DNA, 256 bp, Homo sapiens
gatggtcttgatctcctgaccttatgatccgccctccttggcctcccaaagtgttgggattgcaaggcgtgagccactgcgcccagcctccaggcctcagttttcttatgtgtaaatggggatgataaaacccggacctgcctatgaacggttcagttggatcaaagtagaatgagtgcagaagaagaagcatgatttgtaaaagatggtacaaaagctagtattttaaaaggtgttttacaaagcactttcacat

SEQ ID NO: 344129 - DNA, 822 bp, Homo sapiens
gttaaaagcaggcatagttgaattattcttaatatccactgtcctcatcctcttctcctgtcattctgtaaactgacctagtcctcccctacgtttaggacttaggctagtgaaactgaccttctcagctacaagaggactatatgctacttttttagtacaaaattcattgagggtgtgttcaccttgacctcacttgtttataactaacacacaaataccagaaggcccttaccatacctctttatgttgcttacatggatatttcactacagtgcattgtttctgttaacattagttcaaaattcaacctcttccagagtcagccttagttttaaataaaactaataactgttagacatctggtggtatgaaaataaaaaaactaataactgtgtttctagactctaatgggtatagcctaaactgagataagtgcagttttcctttttactcctaaagtgtaagtaaggtaagattgtttcatgggaagtcaatagcttcctgaaacaatgctttgtcttctcatgctgttaaccagtagtttattagaatgatttaaagccttttgaatataactgctttgctgctttttaagatcaagccctcttgttggatgttaacatttagtactgagcatttgagttgcatctgtcctaataatagattgtattttgaagtcatttttgttactgaccttttgatttttattttttattattattattttttattttgactgagtttcactctgtcacccaggctggactcagatggcgccattgtactcctgtctgggcaacaagagcaaaacacagtctt

SEQ ID NO: 344130 - DNA, 479 bp, Homo sapiens
acaatccagttgtctatcaactgatgaatggatgaataatatgtagcatattcatgcaatagaatattttctgcaataaaaggaagtgctgataaatgctacaacatagatgaatttgaaaccttatgctaagagaaaaaaaagctaatgacaaaagaccaccgattttatgattccatttatgtgaaatatccagaatagtcatagtcacagaaacagaaaggagattagtggtggcctagggctgatggaggaaaaggaggatggagagtgactgctggtaggtactaggctttgttagggggcataaagatatcctaaaactaaaccgtggtgatgattgcatagccctatgcatatttagtgagtatactaaaacccattaaattttacactttaaatgataaattgtataatatgtgaattatatctcaataaagttgttttgggtttttttgtttgttttgagacaggacctc

SEQ ID NO: 344131 - DNA, 459 bp, Homo sapiens
cttttttttttttgagagggagtctcgctctgtcaccaggctgaagtgcagtggtgcaatctcggctcatggcaacctctgcctcccggattcaagtgattctcctgcctctgcctccagagcagctgggactacaggtacgtgccactacacccagttgatttttgtatttttagtagagatggggtttcaccatgtggctaggatggtctcgatctcttgacctcgtgatcctcctgcctcagcctcccaaagtgctgggattacagatgtgagccaccacgcctggcctgggttctggatttttacatgtggggaggaggtgggattttgtggttatttgcactggtggctggttcaactctgggaggcttggggaagggggagaagtttatgagtcttttggtccagactaaactcatcaaaggaactggcctgacataaccattcacatgtgag

SEQ ID NO: 344132 - DNA, 451 bp, Homo sapiens
acaggtggtctgtagaccacacttcaagaattatcttcaaggattgggctagttttagtttgtagtgatttcttgtgtctcttaatgaaggcctagtcaatatagtctggattgattggataaacacagaggaacaagagagcggcagaattgtaccatgcatgcagcaggccatgctctacacgggcctctcaggatgcagcagagaggtaggatatacaggctttttggaatactgatgtgagtgtagaggccagaaaaatgaagctaggtggtattggaggagaatctctgaagactgctctcagtaggctgacaacaagttaagatgaatgtgtaactgttttctacattcttcttactgctataaaaataattgaaatgcagaatgcttaacttcattcagctgtaagccttgtaagaacatcaataaaaatttaaaaattctaaa

SEQ ID NO: 344133 - DNA, 476 bp, Homo sapiens
  misc_feature (10)..(10): n is a, c, g, or t
  misc_feature (18)..(18): n is a, c, g, or t
  misc_feature (26)..(26): n is a, c, g, or t
acttctaagnccccaagncttggaanacaggaaggcctagtcaatatagtctggattgattggataaacacagaggaacaagagagcggcagaattgtaccatgcatgcagcaggccatgctctacacgggcctctcaggatgcagcagagaggtaggacactgaaactggacattgtagaagatgaattatgagagtgatttatgaaagaaagacagtggagaattgcaatcgatggagacattcaaagaaaagactttggcactacatcaaaagagagtagaataaatgacgaaactaaagcacaaagagattaaagaacttatccaaggtcatgcagctggaaagaagtggatttgggattgtgaacatcacaatttcacaaactacatttcatgatgggtagagctagtcaaacgtctgaaaataaagtttggcctcgttggcctcagcggtggagctctgcggccggaaag

SEQ ID NO: 344134 - DNA, 486 bp, Homo sapiens
ttacatggtttatgtctctcaaaatatcttatacattcttaaacattttcagaaagcagttggtgtagataactgaaactgcagaagagaaaactgtgaataaaagggaacaactgtacccttacaaccaccactgtaatcaagaggtataacagcttcatcagttcaacactgaaactggacattgtagaagatgaattatgagagtgatttatgaaagaaagacagtggagaattgcaatcgatggagacattcaaagaaaagactttggcactacatcaaaagagagtagaataaatgacgaaactaaagcacaaagagattaaagaacttatccaaggtcatgcagctggaaagaagtggatttgggattgtgaacatcacaatttcacaaactacatttcatgatgggtagagctagtcaaacgtctgaaaataaagtttggcctcgttggcctcagcggtggagctctgcggccggaaag

SEQ ID NO: 344135 - DNA, 492 bp, Homo sapiens
  misc_feature (56)..(56): n is a, c, g, or t
tacttatcccattaacagcaccgcgtgatttcataaaataaataaaacccctcganaggcaccagttggtgtagataactgaaactgcagaagagaaaactgtgaataaaagggaacaactgtacccttacaaccaccactgtaatcaagaggtataacagcttcatcagttcaacactgaaactggacattgtagaagatgaattatgagagtgatttatgaaagaaagacagtggagaattgcaatcgatggagacattcaaagaaaagactttggcactacatcaaaagagagtagaataaatgacgaaactaaagcacaaagagattaaagaacttatccaaggtcatgcagctggaaagaagtggatttgggattgtgaacatcacaatttcacaaactacatttcatgatgggtagagctagtcaaacgtctgaaaataaagtttggcctcgttggcctcagcggtggagctctgcggccggaaag

SEQ ID NO: 344136 - DNA, 460 bp, Homo sapiens
  misc_feature (10)..(10): n is a, c, g, or t
  misc_feature (18)..(18): n is a, c, g, or t
  misc_feature (26)..(26): n is a, c, g, or t
acttctaagnccccaagncttggaanacagcagttggtgtagataactgaaactgcagaagagaaaactgtgaataaaagggaacaactgtacccttacaaccaccactgtaatcaagaggtataacagcttcatcagttcaacactgaaactggacattgtagaagatgaattatgagagtgatttatgaaagaaagacagtggagaattgcaatcgatggagacattcaaagaaaagactttggcactacatcaaaagagagtagaataaatgacgaaactaaagcacaaagagattaaagaacttatccaaggtcatgcagctggaaagaagtggatttgggattgtgaacatcacaatttcacaaactacatttcatgatgggtagagctagtcaaacgtctgaaaataaagtttggcctcgttggcctcagcggtggagctctgcggccggaaag

SEQ ID NO: 344137 - DNA, 496 bp, Homo sapiens
  misc_feature (10)..(10): n is a, c, g, or t
  misc_feature (18)..(18): n is a, c, g, or t
  misc_feature (26)..(26): n is a, c, g, or t
acttctaagnccccaagncttggaanacaggaaggcctagtcaatatagtctggattgattggataaacacagaggaacaagagagcggcagaattgtaccatgcatgcagcaggccatgctctacacgggcctctcaggatgcagcagagaggtaggacactgaaactggacattgtagaagatgaattatgagagtgatttatgaaagaaagacagtggagaattgcaatcgatggagacattcaaagaaaagactttggcactacatcaaaagagagtagaataaatgacgaaactaaagcacaaagagattaaagaacttatccaaggtcatgcagctggaaagaagtggatttgggattgtgaacatcacaatttcacaaactacatttcatgatgggtagagctagtcaaacgtctgaaaataaagtttggatggatgcggccgaaccctgcgggaagcattctaaataaatgaatgtatactttctaat

SEQ ID NO: 344138 - DNA, 179 bp, Homo sapiens
acactgaaactggacattgtagaagatgaattatgagagtgatttatgaaagaaagacagtggagaattgcaatcgatggagacattcaaagaaaagactttggcactacatcaaaagagagtagaataagtagtctttgcttatacattttaaatgaaaataaatgtttatcatacat

SEQ ID NO: 344139 - DNA, 255 bp, Homo sapiens
tctgaggagccaatgacccctttcaaaatagggcttttttccacctcccaaccctgccccaaccctatcagagcataaatacagctaatcaacctgggtgcagttgatgagctcaataatgtctcttggtcatcagtgacagcattgaaaacaattgcttggcttcttgattctcactcctgaaaatagtcctctcacttggtttctcccttgcgttttgaggacagtcatagagacactttcctcatgtctgat

SEQ ID NO: 344140 - DNA, 776 bp, Homo sapiens
ggattttgaaaaattcaaactgtgaacaccacaatgttatagagcatatgaggtagtagccagcatgaaggatgttttcttcctgagaaacagtgtcaagggctggaggaagagggcaaaatagcagactcagagggcaaataaattttggtattacttggtcacacaaggttatacaggtgttttcttgtaggatttttcagagcctttaatagtctaatgttgcattgagaatctcaaagaggaaaccatagaatgaggcatttgccatacctatctgatcatgaattttcttttcccccacagccttctcctgtgtcaatgtccaatgaagcacgatttgggaaactgtcctagagaaactttataccttcccgctcttctggagatcttttcctcttttcattcatctactttccccaaccagccatctgcctaagaaaggtcacatgttatcatctcatttttgtttagcctctgcagctgtggactatctttattacataggaattctttactagcttgtcctgtatttaaaaatattctaagttttgaggcaaagaagatccagatgctgcaataaatatatgcactgaggagttcacaggcctgacttttggtctcctttctaccactaactgtgtttttgttcctctctgagcttcattttctcatctccaatacggaagtattagaatcagtgatctctaggctctttaagattaatgactttgagatatccctgggagtccttagctcttatggagcagcgtccc

SEQ ID NO: 344141 - DNA, 508 bp, Homo sapiens
gccccaagttcccagttcatgtcagacactgaagacacacttgtgaggatcgggaagccccgcggtagccccagtcgacctctgggtgccacgtggcacctccactgttgtgactacacacacaagcccgggacacccacttgttagctcaggaaccaggcggccagcagatatctgctcagatgaacgtccagagactcaatcctctggcattctcaggttcaaggttggaaaacgcattaagacgagagccacacagtcagcagaatctgcgccattagctttctcgtacttaaacgtctgtctaaataagagtcaaaggcacaaaatgagaaggaatatcttactagggattgtgacttgcacttgccatattttgaaagtactggttcctatcttgctctctcaaactgcatttaagaaaccctacatcagaagttattttcatttcttctgtgaaaaacagaaaatcaataaaagactggaaaaacatatgaaatataattct

SEQ ID NO: 344142 - DNA, 486 bp, Homo sapiens
gctcaaaaaagtttcatttttttatttagctttctgacttagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataa

SEQ ID NO: 344143 - DNA, 874 bp, Homo sapiens
cccgcgggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggtgaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttcatttaaaaattaaaatgtttaattgagatctttttaatgaccctagatgccggtaaaaattaacttgtaaaaaacttccaggtggcctgggtaaaggctttggtcaaaaaggttaattaatggtcaagctggctttaatattcctttggcaattggaagcttttgagcccgggtttttggatcattggttgcccttttcaccggtggtctgc

SEQ ID NO: 344144 - DNA, 378 bp, Homo sapiens
ctctagacgatcccctgacacgccgaacgtccatacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtggttcctcggcgtggggtaccgag

SEQ ID NO: 344145 - DNA, 762 bp, Homo sapiens
cccgcgggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggtgaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaaggtatatattactttggaaggccttttgcttttgattttaatataaatacttattttagctttataattattgaatgttttatacaaaggatggaggcagagttaatttataaaattagtgggaaaagtttacactttctggcattgcatagttaccagtttaagaggatcataaacacccatactctcacatattcacagaattttttgtaatttgacacataaactttaaagcagaccatccatttcaagtagtagccccatgttactttcagtcccctacctagcaagactgattactctcaagctcccttctttttaacctagaaataggtggacacaggtcttcctaagctttctacttactaacctcttgagaaagtgccaccactcacaatactggttgaatatccct

SEQ ID NO: 344146 - DNA, 2121 bp, Homo sapiens
cccgcgggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggtgaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataattacttgccacttgaatgtgttttgtgtaatgttttaacagtgctagtaaataaatacgggtttaccctgg

SEQ ID NO: 344147 - DNA, 1998 bp, Homo sapiens
cccgcgggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggtgaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataa

SEQ ID NO: 344148 - DNA, 2015 bp, Homo sapiens
atttgagctatttcgaaactatttttttctctagaattaagtgctgagaatccatattgagactggttcgtgtaggtttccctgtgttgacttgagaacacatggcttttgaacttgattacaatttgggggtctttgaatcttgattacttagctatttttcctcctgctttgttgaagtattgctggatattagtttgtaaagttgttaaaatctgtgtgtcttatttttgatacattagcttttttgtgtatattaaggtagttttatgtacattgaaaaaatgaacatgtattttaatttttctaccagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataa

SEQ ID NO: 344149 - DNA, 1996 bp, Homo sapiens
cccgcgggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggtgaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaagatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataa

SEQ ID NO: 344150 - DNA, 1994 bp, Homo sapiens
cccgcgggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggtgaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcagtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataa

SEQ ID NO: 344151 - DNA, 1906 bp, Homo sapiens
cccgcgggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggtgaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataa

SEQ ID NO: 344152 - DNA, 1661 bp, Homo sapiens
  misc_feature (15)..(15): n is a, c, g, or t
  misc_feature (18)..(18): n is a, c, g, or t
gttttttttttggcnccnctgtcgattcggctcggtacccagttcgccggagactctcacgctggctgcagggccccggtgacagcgtgagagtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtattgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataa

SEQ ID NO: 344153 - DNA, 1854 bp, Homo sapiens
ttaatagaatgtttaaatatggaattagaaattatataacgtgattgtaaatctgtaaaacaccatcatgaaataaattctatttgtctgctctgaacgagctttttagccactttcattgaaagagtgaggaagaacttgattatctgatactagaaaccttggttagatgtgcattctatacttatgatctaattctaggagtacattacgattgtgtaaacacaggatcacccagtttgttaatattgctatctgacttttcaatcctaattctaataaggttgacttgactaacaattttaatgtgatttttttcctttttaatccttggaaggtaatgcacaaaaatttgcacaaaggtactttccctttctgttcctaagattttcatttaactgactttcaagagggcagcagaatagacttcatctttttggaatgaaaaggtctgccgtgaattgtggtatgttgccactaatgtaatgcctagaacaagagcctagattatattcatttctaacacttttaagactgttttcttaactgtttgcttttgggtctttactttttctagcccatgtttttaattaatttttttccttttgacagtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataa

SEQ ID NO: 344154 - DNA, 1432 bp, Homo sapiens
  misc_feature (11)..(11): n is a, c, g, or t
  misc_feature (25)..(25): n is a, c, g, or t
  misc_feature (38)..(38): n is a, c, g, or t
  misc_feature (63)..(63): n is a, c, g, or t
  misc_feature (112)..(112): n is a, c, g, or t
  misc_feature (126)..(126): n is a, c, g, or t
  misc_feature (128)..(128): n is a, c, g, or t
  misc_feature (133)..(133): n is a, c, g, or t
  misc_feature (156)..(156): n is a, c, g, or t
  misc_feature (162)..(162): n is a, c, g, or t
  misc_feature (177)..(177): n is a, c, g, or t
  misc_feature (203)..(203): n is a, c, g, or t
  misc_feature (220)..(220): n is a, c, g, or t
  misc_feature (225)..(225): n is a, c, g, or t
  misc_feature (230)..(230): n is a, c, g, or t
  misc_feature (246)..(246): n is a, c, g, or t
  misc_feature (259)..(259): n is a, c, g, or t
  misc_feature (275)..(275): n is a, c, g, or t
  misc_feature (280)..(280): n is a, c, g, or t
  misc_feature (358)..(358): n is a, c, g, or t
  misc_feature (362)..(362): n is a, c, g, or t
ccgcccatggncgggccccccgggnaatttccgatttnaaaagttttttaaaccccagggttnttaaaaaaaaccttgtttgcccccaaatttccaacccaaggtgcccaangccatttcccaaancnttttnggtttaaaaccccttaccccaanccattnctttaaaaattgggnccctttttcccctggtggggttgggntaccccctttttaaaanaaggnccggnaattgaaaaaggcttnccttaataatccnaggtttttggcccccnatttncttaaattccacctttttccccaggtattcccccaaaagagaaggattttttttacctttaataattaattaagtccntaanaaggtttgccaagcttgggtaaaaacccaagagggcttaccatccccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataa

SEQ ID NO: 344155 - DNA, 904 bp, Homo sapiens
cccgggctcgcaggaattcggcacgagagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataa

SEQ ID NO: 344156 - DNA, 731 bp, Homo sapiens
gcggccgcccgcgatctagaacgagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataa

SEQ ID NO: 344157 - DNA, 262 bp, Homo sapiens
tgtgttttgtgtaatgttttaacagtgctagtaaataaatacgggtttaccctggttttaattgtaataggtgcattttacacagcatggtttcataatttaacatctgggcaagccagactcattaattacaggaataaggaagtagcgagttttctggtattgtttgaatatccacataaccaccttttgaacttttccttgagaaataattttgtaaatcaagcagtattacttacgaataaatgcctttgggtaatgt

SEQ ID NO: 344158 - DNA, 2050 bp, Homo sapiens
cccgcgggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggtgaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataa

SEQ ID NO: 344159 - DNA, 2414 bp, Homo sapiens
  misc_feature (2375)..(2375): n is a, c, g, or t
cccgcgggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggtgaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataattacttgccacttgaatgtgttttgtgtaatgttttaacagtgctagtaaataaatacgggtttaccctggaaaaaaaaaaaaaaaaaaaaaaaaaaaaacccgggggcctcttattggggggggggaaaaaggggtaatatggacaggccgccaagtgtgtcatatagagcgtgtcctcggtaaccccaactttttctttgtatacacaggggtggaaacactgccgcgcggacccccaatagtaggaggaaggccagcgaaataaaatacaacgaaaaagcgcaagcgttacccttgcttagactcacttccgcagcaaaaangaaaataacaaaaacaaacaccacacaacacaaacaggg

SEQ ID NO: 344160 - DNA, 2090 bp, Homo sapiens
cccgcgggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggtgaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataaacaaaaaaaaatcacatagtacaaaccatcaggaaacaag

SEQ ID NO: 344161 - DNA, 2336 bp, Homo sapiens
cccgcgggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggtgaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataaaaaaacaaaaaaaaagaaaaacaaaaacaaaaaaaaaaagacacacacactacacacgccgggcgggcgcgcgcagcggcagagagaagagaccgtctaaaacaccggcagagagggagggggggaaaagagaggggcggcagacgagcaacagaaggagagaacaaaaggaaaacaagagacacaaaaaaaagggagagggaaaactacaagaagagataaaaaacagcgggggaggaaaccgcagaaggcaataaaaaaaagacagacggagaagatcgagagaaaagggagggaaacaacaaaagggaagcaaagaagactgaagacaaaaacaccga

SEQ ID NO: 344162 - DNA, 1869 bp, Homo sapiens
cccgcgggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggtgaggcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataa

SEQ ID NO: 344163 - DNA, 1913 bp, Homo sapiens
cccgcgggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggtgagactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaagatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataa

SEQ ID NO: 344164 - DNA, 1617 bp, Homo sapiens
cccgcgggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggtgaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttcgaagcagagtctcgctgtgtcacccaggctggagtgcagtggtgcgatctcagctcactgcaatctccacatcctgggttcaagtgatcttcccacctcagcctcatgagtatgtaggattacagcatgctcataa

SEQ ID NO: 344165 - DNA, 552 bp, Homo sapiens
atgaacacaaatgcgcagtctcctctgcgatcggtagctaaggatgttaggccatgattggactaggatgggagatgaactgagaactatggattctgtaggttgttgttgtctcttcccaccccaagcaacaagtgatgacacacacacacacacacacacacacacacacacacacacacacacatcccgtagtgactaacaggatctccctccaggggatttgcagaaaggggagcagaaaacatcccaggggcctttcacagctacttccttgagccccctttcagactgctgtctagacctgtcgcagcccaaacatcaccaccctgatatgcagaagctggcatccttacctgaaattcaacaccaagaaatgatctcttctactcaacactgatagaaatacctctaagcaatgtcctcattggcaggggtggagtgggggagtttcttaaaaagtgaggcctctgcctaccacctagagaacctggaaatttccatctgtgccacaaagtccaaatcactggccactgcccttgtgtatggcag

SEQ ID NO: 344166 - DNA, 548 bp, Homo sapiens
ttgttggtggagtgacccgagagtatacaggaattgagggcatatgagatctctggactctgcactccattttgctgtacactcaaaactactctaaaataataatatatctttaaaaatctataactagcacgtagcccttttcaagcctccaactggttggagccagttcgattaaagctcagaagaaaaactggttaataagctagttctgacccaactggcaagaagcggcaggaaagacccaggccaggggagcatattgcacatgcatgcaccaggaaactggaggaagcttggaggccctttagcctggtcctgagcccgctgaaactgcagttacagcacagatgcctggggcaccaatctgaatctgccaacatccaaggccacatgaacacaaatgcgcagtctcctctgcgatcggtagctaaggatgttaggccatgattggactaggatgggagatgaactgagaactatggattctgtaggttgttgttgtctcttcccaccccaagcaacaagtgatgacacacacacacaca

SEQ ID NO: 344167 - DNA, 446 bp, Homo sapiens
ttttttttgagacgagtctcgctctttcacccaggctggagtgaagtggcctgatcttggctcactgcaacctccctgccctggagcttcaagcgattttcatgcctctgcctcccaattagctgggattatagacgcccaccatcacacccggctaacttttgcatttttagtagagactaacatggtttcgccacgttggccaggttggtctcgaactcctgacctcgggtgatccacccgcctcggcctcccaaactgctggtattacaggcatgagacaccaagcccggccatatacatttttattaaaatcgttctgtaggttccagaggaaaacgtcctcttgacagtcatggaatacaaatacagtacttatcattttgtctgtaagatttccataattttccacccaacatattaaatgactgaatgaatgcgagctt

SEQ ID NO: 344168 - DNA, 430 bp, Homo sapiens
cgtgggaagaagggcagctgcaagcagatctgtccacctctgctgagaagcccaggacctctgggtagtgcagggcaggacgggacaaggggcttccgcctgtggtcagtgtattcacagtcctcttcaaagatcagagagatccacgcctgctgttgccaccagcaccggggctcctaggcttcacttcagacactgcagcaagggcagccctggggtgctttcggctccccagccccctccccccaaccttgaaaggaaagatcagcgttccatcctcagtttcaagatggggacactgatggcaacgtggacttcagggagccccaaggggaggtgagggaaggagagggaatcatatcctagggttgctcaaagatgttggctaccattataaccctcagtgagtgctcactcactgttatcatca

SEQ ID NO: 344169 - DNA, 498 bp, Homo sapiens
gtaggacaagcaaaaatgagggtaaagtggtgggcagggggaggtgaagagtgtcatgaaggtagctctattgtgctggagtgcaggaggattgagagatgtgagggatatcagactgaggacgtgaactggagccaagcggagggggagaatgtattctgtgcacaattgggaaggttttaacaatgtttccagagaggataacaggttttaacaatgtttccagagagagaataacaggacaatagctatgctttggaaagagaaatctgatggcagcctggagaatggcatgggaggggagagagtgatggcaggcagttaggctcaaagcctggagcaccctccccggccagagtgtgtgctgagccccttagtgaaattgacctcacacggtatatgagtctgagaattagccatgtagaatgtatacatataaaaaatacctataaataatctcttcatcttctactacatggtcctttttagttttcctct

SEQ ID NO: 344170 - DNA, 357 bp, Homo sapiens
ctgtaataagaaagaggctgctttgtgcccctcatgagactgcctcttgtcccaggtttgtgctcaaaattaaattcatttcctctttcccaaacctcattgggaaggcttcatcacagggcttcaccatttctgtgagttgcacctccattccactaatccttttggtgatttcttctccctcacatctaatttttagtaatttcctattgcttctataacaaattatcaaaaatgtattagcttaaaagaataaattatcttacaggtctagaggtcagaagtccaaaataagtcacactgagctaaaatcaaggtgttggcagggagtctttaggagagaatctgttttttgtt

SEQ ID NO: 344171 - DNA, 808 bp, Homo sapiens
ttagtcttctcttccatcccaaccatctgccctatagatacgtgctattagtcatttggaattggattaggaattcaaaccaaagtctaggtaaaatagtcaatagtatttatctgtcattaatccatcacttatttttaagaaagaaacaatgagtgcacagcctaataatggaggtctctctgtgaaatgaggcacattatacatttcaacagctctactgaaattgagtaccagaatacagaacttaactcaaataatattatattgagtataagaataagaaaggttttttttttttggtttgtttcctacataattggggtgagtggataaaagtagtttaaacatcctaaggggtagacaagattaatttgatgttcgtgacacggcccaagtacctgtttatcttaaaagcgcatgatgtatgggaacagaatggaaaaataaggccaggtgagtaaaattgttcagagattttaaaaattaaaaaaagaaaaaagacattagtgaaggagtgcagtaaatagccaacagctgttttcattctcctgaaaagtagtgaagtagtgatggcaataattatgaagaaattgaatgccgagtaagagaatgcagtaatggatttagaacctattagaatgagccataggaaaaggtataaatgggttgtgatggaggccaaggacagagaattcatttggttaatgtcccagtatctataataatcagtgaaagaacaagaaaatcatattaagaaagcaaaagcagactgggcacagtggctcacatttgtcatcacagcact

SEQ ID NO: 344172 - DNA, 475 bp, Homo sapiens
ggcagctagggtagcatcatgccggaggaggacaaacgcctgctgaggtggtgaccctgccttgccctgccaagcacgtagcagttagcaccaactagatacagacatactccacaggagttggaaggggcagagagaagggttcgtaccctgatcagggagtgtcctcccacaactctaaggccaagcctatcagcccttccaagtgggagtgctgccagctttctgtttactgtgaccacctgtgtgcagcaattgggtctgtcacctacaggaaagggacatacatatctgctggccactgtcaacatcacctgtataacaagagattaatatgccttgaatatgtacagaatgtttttcaaaggacagaagcagctctggggaagaagaggacttcagcttttcagtcttctgcattctttcagtattttgccacatatcaggttttgttttgtttttgagacagggtctc

SEQ ID NO: 344173 - DNA, 619 bp, Homo sapiens
cgttttcaggggaatgaattggaagtaaccattatgatggtggtagaagcattatgtgaacttcattgtcctgaagctatacagggaattgctgtctggtcatcatctattgttggaaaaaatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccaatgctgggcgtaacagtgccagcccgaaacattctctgaatggtgaatccagaaaaactgtgctgtccaaaccgactgactcttcccctgaggttataaattatttaggaaataaagcatgtgagtgctacatctcaattgccgattgggctgctgtgcaggaatggcagaacgctatccatgacttgaaaaagagtaccagtagcacttccctcaacctgaaagctgacttcaactatataaaatcattaagcagctttgagtctggaaaatttgttgaatgtaccgagcagttagaattgttaccaggagaaaatatcaatctacttgctggaggatcaaaagaaaaaatag

SEQ ID NO: 344174 - DNA, 433 bp, Homo sapiens
cgttttcaggggaatgaattggaagtaaccattatgatggtggtagaagcattatgtgaacttcattgtcctgaagctatacagggaattgctgtctggtcatcatctattgttggaaaaaatcttctgtggattaactcagtggctcaacaggctgaagggagcattgaagcttgctataaatcacttcaccaggaggcgtcttcagtttgttctttagttagcagcaatacttgagtgcctttcttactgaagaattagtggcaaatcacactgtaaaacaagacctgagcaagccagggggtctcggcagcttaactccacattgaaatctgtggggacagccacaatgctgcaaatcctctctcccctcttccctatcactcctcttttccttccttcagtctccataaaagggaagggaagcttcgat

SEQ ID NO: 344175 - DNA, 1281 bp, Homo sapiens
tgcctgggcgacagagtgagaccctgtctccaaaaaaaaaaaaaaaaaaggaagacttctggctgccttttcctttttcaaaggcattttactggtctcttgggagcactgcagtttttttttaaaaaacctggaaacaaagttcgttaatatctgtagaaaaaagaggttatgtgcagtgctcacacctgtaatcccagcactttgggaggccaaggcgggcagatcacctgaggtcaggagtttgagaccagtctggccaacatggcaaaaccccatctctactaaaaatacaaacattagctgggtgtggtgttgggcaccttataatcccagctactcgggaggctgaggcaggagaatcacttgaacccggggggcggaggttgcagtgagctgagatcatgccactgaagttcactccagcctgggtaaaagagcaaaactccatctcaaaaaaaaaaaaatctataaaaaagaaatcaaacaaatttattaggaatgtggctctctttctcagagtttttccctttgtgctataaaagcaagttttaaaaggaactgaaatgacagctcagcaggtagaatcatttagtaaactcatagagctcctggcactgcttcaagggcccctgtgggctgtgttgggcttgtctaggttatgtatctcttttcaattattttcttagttaatcatcaaatttttaattgagcaaccttctagagcagttggatttacatgcacttttgggcacgtggatttgctgccatttattctagaatttttgaagggctagacccctggacatagcagatagctctattgtttaggatcaaacaaacctccagcaggatccttggaacgaggaaggagccaggacttagcagagcacgccaaggtattcgctgaaggaaactggcccttccaggggactgcatggaacccggggggttgggaatacagtgccccaaaacccagtgtgtcttttaagttcagcctccctagccagtgtgccctgtgcgtgatcactgtaaagccacacctttcaaatcaggaggtgtaagaagttgtctttaacctaagggaagaggaaacagtttgctaaaaataaggccattacctgctggaactgtcacagtaggttctaattaacttgtctcctcttgttgttttcaaaatgatgtattctaattcaaagtaaagactgtagagacaattctaaattattttcttcttttttagggggtgttgtggggagggtctcactctgtcacccagat

SEQ ID NO: 344176 - DNA, 514 bp, Homo sapiens
gaactctggggctcaagcattcctcccacctcagcctcccaagtagctgggcctacaagtcttcttggcttcaagtcttcttcctcagcggtctcactctgtcaccaaggctggagtgcagtggtgctgcgatctcggctcactgcaacttccacctccaaggcccaagcgatcctcccaccacagcctcctgagtggctgggactagaggaaacattcaaatcagttgacaaagaatggctgatgctgaaatgacttgctgtctcggtgtggagtggaaacaatcctgctaaatttcatattgcagtgacaccaaagcaaaggacagatctcaagacaacttttattgaaatggaaaacagttaattttaactaaagaataagagaaatgccaacagaaataaaagacccagaaatcagaggacaatgtgcgaaactctatatactgagacacacaaattgaaacaacccaaataaatgccaaatgcacaagaaaataaatgtaacttatcag

SEQ ID NO: 344177 - DNA, 365 bp, Homo sapiens
taaaagattaaaatagataattttacgctaaagaaacgcttagtagaaacgaaatcattgtgaaacattcaaatcagttgacaaagaatggctgatgctgaaatgacttgctgtctcggtgtggagtggaaacaatcctgctaaatttcatattgcagtgacaccaaagcaaaggacagatctcaagacaacttttattgaaatggaaaacagttaattttaactaaagaataagagaaatgccaacagaaataaaagacccagaaatcagaggacaatgtgcgaaactctatatactgagacacacaaattgaaacaacccaaataaatgccaaatgcacaagaaaataaatgtaacttatcag

SEQ ID NO: 344178 - DNA, 403 bp, Homo sapiens
taaaagattaaaatagataattttacgctaaagaaacgcttagtagaaacgaaatcattgtgaaacattcaaatcagttgacaaagaatggctgatgctgaaatgacttgctgtctcggtgtggagtggaaacaatcctgctaaatttcatattgcagtgacaccaaagcaaaggacagatctcaagacaacttttattgaaatggaaaacagttaattttaactaaagaataagagaaatgccaacagaaataaaagacccagaaatcagaggacaatgtgcgaaactctatatactgagacacacaaattgaaacaacccaaataaatgccaaatgcacaagaaaataaatgtaacttatcagggaacaaaaaaagaaagcgattggcctccttggcctca

SEQ ID NO: 344179 - DNA, 622 bp, Homo sapiens
atggtctattctaaggtaacaaaaatgtgctcttatgttttcttctaagagcttccactgttttatctttcatacagctggaatcaattttttatgtggtattaggtaggggtcctgatacattttgttcagtatagataaacaaacgactcagtatcattttttgaaaagatcatccttcaaccactacatgccactctcacctttgtcaacactttatctatcactgcgtcagaatctttttaatggctatatagttttccattgtatgcatgtgctataaattactaaatccatccccaattagccaacacttgagagtttccatgtttttggtataaataatgctataatgaataaccttgtccatgtattattccccacatgtggagtatatttgtaagataaactcagagaaacggagttgctaagtcaaagggtatgtgcatttttaatcaatacatgatagaggttataccaactttaattggaattttcaagtcacaatgaactccaaagtattatgataagatacagcacattgccatttcagttactccaaagttcccaacatttttggcccttaggattcttttataaaagacatcaaatgtataacaat

SEQ ID NO: 344180 - DNA, 255 bp, Homo sapiens
agggtttcactctcgttgcccaggctggagtgcaatggcatgatcttggctcaccacaacctccacctcccaagttcaagcgattctcctgcctcagcatgccgagtagctgggattacaggtcatctctctgccatcgggaggcagcatcgagcaaccccgtgctggggcatcaggcaagaccagagctcaaatccaggctgcccacttctcacgtgtaaatgtggatagcagcagtttgtcttacacaaggct

SEQ ID NO: 344181 - DNA, 6561 bp, Homo sapiens
caccttctttagtgctgcccctgggcagaatcccatcgtgcctgagacccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttgtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacgaaataaagagtttaaacatagcaacaacccagcacacaagtactacttggcagtggaccccgtgtccggctcgctctacgtgtccgacaccaacagcaggagaatctaccgcgtcaagtctctgagtggaaccaaagacctggctgggaattcggaagttgtggcagggacgggagagcagtgtctaccctttgatgaagcccgctgcggggatggagggaaggccatagatgcaaccctgatgagcccgagaggtattgcagtagacaagaatgggctcatgtactttgtcgatgccaccatgatccggaaggttgaccagaatggaatcatctccaccctgctgggctccaatgacctcactgccgtccggccgctgagctgtgattccagcatggatgtagcccaggttcgtctggagtggccaacagaccttgctgtcaatcccatggataactccttgtatgttctagagaacaatgtcatccttcgaatcaccgagaaccaccaagtcagcatcattgcgggacgccccatgcactgccaagttcctggcattgactactcactcagcaaactagccattcactctgccctggagtcagccagtgccattgccatttctcacactggggtcctctacatcactgagacagatgagaagaagattaaccgtctacgccaggtaacaaccaacggggagatctgccttttagctggggcagcctcggactgcgactgcaaaaacgatgtcaattgcaactgctattcaggagatgatgcctacgcgactgatgccatcttgaattccccatcatccttagctgtagctccagatggtaccatttacattgcagaccttggaaatattcggatcagggcggtcagcaagaacaagcctgttcttaatgccttcaaccagtatgaggctgcatcccccggagagcaggagttatatgttttcaacgctgatggcatccaccaatacactgtgagcctggtgacaggggagtacttgtacaatttcacatatagtactgacaatgatgtcactgaattgattgacaataatgggaattccctgaagatccgtcgggacagcagtggcatgccccgtcacctgctcatgcctgacaaccagatcatcaccctcaccgtgggcaccaatggaggcctcaaagtcgtgtccacacagaacctggagcttggtctcatgacctatgatggcaacactgggctcctggccaccaagagcgatgaaacaggatggacgactttctatgactatgaccacgaaggccgcctgaccaacgtgacgcgccccacgggggtggtaaccagtctgcaccgggaaatggagaaatctattaccattgacattgagaactccaaccgtgatgatgacgtcactgtcatcaccaacctctcttcagtagaggcctcctacacagtggtacaagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaacaaaataatctgctgccattccttgtctgaatggctcagcaggagtaactgttatctcctctcctaaggagatgaagacctaacaggggcactgcggctgggctgctttaggagaccaagtggcaagaaagctcacattttttgagttcaaatgctactgtccaagcgagaagtccctcatcctgaagtagactaaagcccggctgaaaattccgaggaaaacaaaacaaacgaatgaatgaacagacacacacaatgttccaagttcccctaaaatatgacccacttgttctgggtctacgcagaaaagagacgcaaagtgtccaaaaggaacaaaagaacaaaaacgaataagcaaagaagaaaacaaacaaaaacaaaacaaaacaaacacacggaccgataaacaaagaagcgaagataagaaagaaggcctcatatccaattacctcactcattcacatgtgagcgacacgcagacatccgcgagggccagcgtcaccagaccagctgcgggacaaaccactcagactgcttgtaggacaaatacttctgacattttcgtttaagcaaatacaggtgcatttaaaacacgactttgggggtgatttgtgtgtagcgcctggggaggggggataaaagaggaggagtgagcactggaaatactttttaaagaaaaaaaaacatgagggaataaaagaaattcctatcaaaaatcaaagtgaaataataccatccagcacttaactctcaggtcccaactaagtctggcctgagctaatttatttgagcgcagagtgtaaaatttaattcaaaatggtggctataatcactacagataaatttcatactcttttgtctttggagattccattgtggacagtaatacgcagttacagggtgtagtctgtttagattccgtagttcgtgggtatcagtttcggtagaggtgcagcatcgtgacacttttgctaacaggtaccacttctgatcaccctgtacatacatgagccgaaaggcacaatcactgtttcagatttaaaattattagtgtgtttgtttggtccagaaactgagacaatcacatgacagtcaccacgaggagagaaaatttaaaaaataaaaataaaaacaaaaaaaattttaaaaattaaaaaaacaaaaataaagtctaataagaactttggtacaggaacttttttgtaatatacatgtatgaattgttcatcgagtttttatattaattttaatttgctgctaagcaaagactagggacaggcaaagataatttatggcaaagtgtttaaattgtttatacataaataaagtctctaaaactcctgtgg

SEQ ID NO: 344182 - DNA, 3030 bp, Homo sapiens
  misc_feature (26)..(27): n is a, c, g, or t
tatgctgtaccagaggatcccccagnnaaacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaacaaaataatctgctgccattccttgtctgaatggctcagcaggagtaactgttatctcctctcctaaggagatgaagacctaacaggggcactgcggctgggctgctttaggagaccaagtggcaagaaagctcacattttttgagttcaaatgctactgtccaagcgagaagtccctcatcctgaagtagactaaagcccggctgaaaattccgaggaaaacaaaacaaacgaatgaatgaacagacacacacaatgttccaagttcccctaaaatatgacccacttgttctgggtctacgcagaaaagagacgcaaagtgtccaaaaggaacaaaagaacaaaaacgaataagcaaagaagaaaacaaacaaaaacaaaacaaaacaaacacacggaccgataaacaaagaagcgaagataagaaagaaggcctcatatccaattacctcactcattcacatgtgagcgacacgcagacatccgcgagggccagcgtcaccagaccagctgcgggacaaaccactcagactgcttgtaggacaaatacttctgacattttcgtttaagcaaatacaggtgcatttaaaacacgactttgggggtgatttgtgtgtagcgcctggggaggggggataaaagaggaggagtgagcactggaaatactttttaaagaaaaaaaaacatgagggaataaaagaaattcctatcaaaaatcaaagtgaaataataccatccagcacttaactctcaggtcccaactaagtctggcctgagctaatttatttgagcgcagagtgtaaaatttaattcaaaatggtggctataatcactacagataaatttcatactcttttgtctttggagattccattgtggacagtaatacgcagttacagggtgtagtctgtttagattccgtagttcgtgggtatcagtttcggtagaggtgcagcatcgtgacacttttgctaacaggtaccacttctgatcaccctgtacatacatgagccgaaaggcacaatcactgtttcagatttaaaattattagtgtgtttgtttggtccagaaactgagacaatcacatgacagtcaccacgaggagagaaaatttaaaaaataaaaataaaaacaaaaaaaattttaaaaattaaaaaaacaaaaataaagtctaataagaactttggtacaggaacttttttgtaatatacatgtatgaattgttcatcgagtttttatattaattttaatttgctgctaagcaaagactagggacaggcaaagataatttatggcaaagtgtttaaattgtttatacataaataaagtctctaaaactcctgtgg

SEQ ID NO: 344183 - DNA, 2955 bp, Homo sapiens
ctatacggttcgtgcttggaaatccttgtggcccttgatcagtttgcatactggtcgctgtcagtccagaatcgtgtcgtgactgtagacaaatccctgacgagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaacaaaataatctgctgccattccttgtctgaatggctcagcaggagtaactgttatctcctctcctaaggagatgaagacctaacaggggcactgcggctgggctgctttaggagaccaagtggcaagaaagctcacattttttgagttcaaatgctactgtccaagcgagaagtccctcatcctgaagtagactaaagcccggctgaaaattccgaggaaaacaaaacaaacgaatgaatgaacagacacacacaatgttccaagttcccctaaaatatgacccacttgttctgggtctacgcagaaaagagacgcaaagtgtccaaaaggaacaaaagaacaaaaacgaataagcaaagaagaaaacaaacaaaaacaaaacaaaacaaacacacggaccgataaacaaagaagcgaagataagaaagaaggcctcatatccaattacctcactcattcacatgtgagcgacacgcagacatccgcgagggccagcgtcaccagaccagctgcgggacaaaccactcagactgcttgtaggacaaatacttctgacattttcgtttaagcaaatacaggtgcatttaaaacacgactttgggggtgatttgtgtgtagcgcctggggaggggggataaaagaggaggagtgagcactggaaatactttttaaagaaaaaaaaacatgagggaataaaagaaattcctatcaaaaatcaaagtgaaataataccatccagcacttaactctcaggtcccaactaagtctggcctgagctaatttatttgagcgcagagtgtaaaatttaattcaaaatggtggctataatcactacagataaatttcatactcttttgtctttggagattccattgtggacagtaatacgcagttacagggtgtagtctgtttagattccgtagttcgtgggtatcagtttcggtagaggtgcagcatcgtgacacttttgctaacaggtaccacttctgatcaccctgtacatacatgagccgaaaggcacaatcactgtttcagatttaaaattattagtgtgtttgtttggtccagaaactgagacaatcacatgacagtcaccacgaggagagaaaatttaaaaaataaaaataaaaacaaaaaaaattttaaaaattaaaaaaacaaaaataaagtctaataagaactttggtacaggaacttttttgtaatatacatgtatgaattgttcatcgagtttttatattaattttaatttgctgctaagcaaagactagggacaggcaaagataatttatggcaaagtgtttaaattgtttatacataaataaagtctctaaaactcctgtgg

SEQ ID NO: 344184 - DNA, 473 bp, Homo sapiens
taggcaaccaccatgatccatcaaaattggcatgtccagtgaaataaatctgtttaatctggtctaagcttcccatctttcatgacttttgagttgacatttggggaaatggactaaattctgtctgtttgaatgcttggtcctcaaaagccaactgatatgttctgttcccctttcctttctgcagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgaca

SEQ ID NO: 344185 - DNA, 5926 bp, Homo sapiens
  misc_feature (5821)..(5821): n is a, c, g, or t
  misc_feature (5841)..(5841): n is a, c, g, or t
  misc_feature (5857)..(5857): n is a, c, g, or t
  misc_feature (5866)..(5866): n is a, c, g, or t
  misc_feature (5908)..(5908): n is a, c, g, or t
caccttctttagtgctgcccctgggcagaatcccatcgtgcctgagacccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttgtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacgaaataaagagtttaaacatagcaacaacccagcacacaagtactacttggcagtggaccccgtgtccggctcgctctacgtgtccgacaccaacagcaggagaatctaccgcgtcaagtctctgagtggaaccaaagacctggctgggaattcggaagttgtggcagggacgggagagcagtgtctaccctttgatgaagcccgctgcggggatggagggaaggccatagatgcaaccctgatgagcccgagaggtattgcagtagacaagaatgggctcatgtactttgtcgatgccaccatgatccggaaggttgaccagaatggaatcatctccaccctgctgggctccaatgacctcactgccgtccggccgctgagctgtgattccagcatggatgtagcccaggttcgtctggagtggccaacagaccttgctgtcaatcccatggataactccttgtatgttctagagaacaatgtcatccttcgaatcaccgagaaccaccaagtcagcatcattgcgggacgccccatgcactgccaagttcctggcattgactactcactcagcaaactagccattcactctgccctggagtcagccagtgccattgccatttctcacactggggtcctctacatcactgagacagatgagaagaagattaaccgtctacgccaggtaacaaccaacggggagatctgccttttagctggggcagcctcggactgcgactgcaaaaacgatgtcaattgcaactgctattcaggagatgatgcctacgcgactgatgccatcttgaattccccatcatccttagctgtagctccagatggtaccatttacattgcagaccttggaaatattcggatcagggcggtcagcaagaacaagcctgttcttaatgccttcaaccagtatgaggctgcatcccccggagagcaggagttatatgttttcaacgctgatggcatccaccaatacactgtgagcctggtgacaggggagtacttgtacaatttcacatatagtactgacaatgatgtcactgaattgattgacaataatgggaattccctgaagatccgtcgggacagcagtggcatgccccgtcacctgctcatgcctgacaaccagatcatcaccctcaccgtgggcaccaatggaggcctcaaagtcgtgtccacacagaacctggagcttggtctcatgacctatgatggcaacactgggctcctggccaccaagagcgatgaaacaggatggacgactttctatgactatgaccacgaaggccgcctgaccaacgtgacgcgccccacgggggtggtaaccagtctgcaccgggaaatggagaaatctattaccattgacattgagaactccaaccgtgatgatgacgtcactgtcatcaccaacctctcttcagtagaggcctcctacacagtggtacaagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaacaaaataatctgctgccattccttgtctgaatggctcagcaggagtaactgttatctcctctcctaaggagatgaagacctaacaggggcactgcggctgggctgctttaggagaccaagtggcaagaaagctcacattttttgagttcaaatgctactgtccaagcgagaagtccctcatcctgaagtagactaaagcccggctgaaaattccgaggaaaacaaaacaaacgaatgaatgaacagacacacacaatgttccaagttcccctaaaatatgacccacttgttctgggtctacgcagaaaagagacgcaaagtgtccaaaaggaacaaaagaacaaaaacgaataagcaaagaagaaaacaaacaaaaacaaaacaaaacaaacacacggaccgataaacaaagaagcgaagataagaaagaaggcctcatatccaattacctcactcattcacatgtgagcgacacgcagacatccgcgagggccagcgtcaccagaccagctgcgggacaaaccactcagactgcttgtaggacaaatacttctgacattttcgtttaagcaaatacaggtgcatttaaaacaaaaaaaaaaaaanaaaaaaaaaaaaaaaaaaanaaaaaaaaaaaaaaanaaaaaaaanaaaaaaaaaaaaaaaaaaaaaaaaaaaaaaaaaaaaaaaaanaaaaaaaaaaaaaaaaca

SEQ ID NO: 344186 - DNA, 2614 bp, Homo sapiens
caccttctttagtgctgcccctgggcagaatcccatcgtgcctgagacccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttgtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacgaaataaagagtttaaacatagcaacaacccagcacacaagtactacttggcagtggaccccgtgtccggctcgctctacgtgtccgacaccaacagcaggagaatctaccgcgtcaagtctctgagtggaaccaaagacctggctgggaattcggaagttgtggcagggacgggagagcagtgtctaccctttgatgaagcccgctgcggggatggagggaaggccatagatgcaaccctgatgagcccgagaggtattgcagtagacaagaatgggctcatgtactttgtcgatgccaccatgatccggaaggttgaccagaatggaatcatctccaccctgctgggctccaatgacctcactgccgtccggccgctgagctgtgattccagcatggatgtagcccaggttcgtctggagtggccaacagaccttgctgtcaatcccatggataactccttgtatgttctagagaacaatgtcatccttcgaatcaccgagaaccaccaagtcagcatcattgcgggacgccccatgcactgccaagttcctggcattgactactcactcagcaaactagccattcactctgccctggagtcagccagtgccattgccatttctcacactggggtcctctacatcactgagacagatgagaagaagattaaccgtctacgccaggtaacaaccaacggggagatctgccttttagctggggcagcctcggactgcgactgcaaaaacgatgtcaattgcaactgctattcaggagatgatgcctacgcgactgatgccatcttgaattccccatcatccttagctgtagctccagatggtaccatttacattgcagaccttggaaatattcggatcagggcggtcagcaagaacaagcctgttcttaatgccttcaaccagtatgaggctgcatcccccggagagcaggagttatatgttttcaacgctgatggcatccaccaatacactgtgagcctggtgacaggggagtacttgtacaatttcacatatagtactgacaatgatgtcactgaattgattgacaataatgggaattccctgaagatccgtcgggacagcagtggcatgccccgtcacctgctcatgcctgacaaccagatcatcaccctcaccgtgggcaccaatggaggcctcaaagtcgtgtccacacagaacctggagcttggtctcatgacctatgatggcaacactgggctcctggccaccaagagcgatgaaacaggatggacgactttctatgactatgaccacgaaggccgcctgaccaacgtgacgcgccccacgggggtggtaaccagtctgcaccgggaaatggagaaatctattaccattgacattgagaactccaaccgtgatgatgacgtcactgtcatcaccaacctctcttcagtagaggcctcctacacagtggtacaagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtttaagaatgatggtggccttccgcagttgtcccagatgaaccaacccgatgtgaccaagcttctgttggcagaggagaagacctatctttctgaccaccactgtgtgttttgctctgaaaatgatggctccaatcccgtataattcagacggcattaacttttggacctgtttttaaaaaaataaaaaatcctactactcag

SEQ ID NO: 344187 - DNA, 562 bp, Homo sapiens
ggtttgctctgtgtgagacatgcaagccttttcaagaactgagctcacctggatattgattccagtggcatgtgtttgcctgtattcttttatctttagattttaggccctcttagaggaggccagggtccattcccaagcttaagaagtaacatcatttaccaaagagccctgtaacaaaacaacccagggttctaagttcacatgtggctcataccccgtaagacctaatttcccggctctgaaccagagtccagctggagatgacctgatggcttcaggggatgtcccagggctattcatttctctttaaaaattttaaatctatttatttgttttcgagttgacaaaaaacgtatatatttgccatgtacaacatggtgtcttgaaacatgtatatgtgccgggcgcgggggctcacttctgtaatcccagcactttggtaggccgaggtggacagagcatgaggtcaggagatcgagaccatcttggctaacatggtgaaaccctgtctctactaaaaatacaaaaaattagccgggcgtggtggcagtcgcctgta

SEQ ID NO: 344188 - DNA, 1801 bp, Homo sapiens
cgcgcggctggggctcggctccgggggtggcggtcggacagtgtctagcacgctcagtccgggcttggggccccgcggcggagaaggaggtagagggggcggcggcggcggcggcggtggtggcggcaccatgtttcttcactcagttaatctctggaacctggcgttttatgtcttcatggtctttctggcaaccctggggctgtgggatgtcttcttcggcttcgaggagaataagtgcagtatgagctacatgtttgagtacccggagtatcagagttcagcagtgcctaagacctgggtctcaacagaccacctctccattgtgtggtgtaaacaattgcagttgactacagttcgagcattctttgatcttattgatgctgatactaaacaaataactcaaaattccaagaagaaactgtcagttttgtatcaccactttataagacacccatcaaaacattttgaggaaaatccagctataatttctgacttaacagggacatctatgtgggttctagtaaaagtgtccaaatggacctatgtagcttacaacgaatctgagaagatatattttacatttcctcttgaaaatcatagaaaaatctacactcatgtctattgtcagagcactatgctggatacaaatagttggatttttgcttgcataaacagcacttctatgtgcctgcaaggggttgatttatcatggaaagctgaactgctgccaacaattaagtatctgacattaagacttcaagactatccatctttgtctcatcttgttgtttatgtaccatctgttcgtggaagtaagtttgttgtagattgtgaattctttaaaaaagagaaaagatacatacagcttcctgtaactcatcttttttcctttggattgtcttcaaggaaagtggtgttaaatacaaatggcctatactacaatctagagcttctgaactttggacagatataccaagcttttaaaatcaacgtggtaagcaagtgctcagcagtcaaagaagaaataaccagtatctatagacttcatattccttggtcttatgaagattcactaaccattgcacaggctccatcttccacagaaatttctctgaaactccatattgctcaaccagaaaacaatacccatgtggcattatttaaaatgtacacgtcatcagactgtcggtacgaggtgacagttaagacttccttttcacaaatacttggacaggttgttgcttagaatatgctaccatgttggataaagaagccaaaccatacaaagttgatccttttgtaattatcattaagtttctgttggggtaagttttattatctgtgataatgattttaattgtgttttacatgtaacattatatttggttccataatgcaatataaattttcatacagatttggcagttgacttgtttcattaaatgaggtttttttttttctcttaggcaaaggtctaataagtatatcaatgtctacttcaatagtatcatttcaaaagtaattattcactttatgtatatcagtctaaacttagactgcctttaatgtttgtaaataggtgtatatggtccatgatctgtgagtatcctagattcaaacgcaaatcattacagggtattgatgaaacagtgcctctctgatcacttttaaaagtatattttagacctctctaccctagttaacattccattcttaatttagtcacattttcagatttttggttaagcatcaatatgtagatctttttttccatcattacaactaacttggctttcta

SEQ ID NO: 344189 - DNA, 707 bp, Homo sapiens
gttcatatttataatattaaagcaatacaaaaaattgtgataaaaatttgactccaactactgcatgctctcaaaatgtccattttttttacaaatactgcatatcttcaagaagtccatattttgacaaaatcattttaaacttccctaaaaatatttatctcctttctaatatcaaatagacttcctaattatcaaaaagttgtatttatggtagagataattaaggatgaatttctttttaaaatattattttggcttaaatttctttagctggcatgatatggtaataagatattctacttaattaaatattttaggtagtaaaggagcaaaatagcattcactcagctgtcaaataattagatatgtgggaaagtatactaaacagtaacactctactttaatgcaatttgcatggtggttcaaaagattctttaagatcttgagtgcctttaaggtttaccattatagaaaatcaattattatgcttagagatatgcataagtgctcaatttaataaaatgtaaaggagtttagaggaaaataaccttttttttcaataattgttttaaactaggtgacagttaagacttccttttcacaaatacttggacaggtaagagagattcctggctggttgattatttactgctttatgaatagataactctaaggaagggttgtagactttttccataaggggc

SEQ ID NO: 344190 - DNA, 2461 bp, Homo sapiens
cgcgcggctggggctcggctccgggggtggcggtcggacagtgtctagcacgctcagtccgggcttggggccccgcggcggagaaggaggtagagggggcggcggcggcggcggcggtggtggcggcaccatgtttcttcactcagttaatctctggaacctggcgttttatgtcttcatggtctttctggcaaccctggggctgtgggatgtcttcttcggcttcgaggagaataagtgcagtatgagctacatgtttgagtacccggagtatcagaaaatagaacttccaaagaaactggcaaaacgctatcccgcatatgagttgtatctttatggagagggatcctatgctgaagaacacaaaattctccctttgacgggtattccagttctctttcttcctggtaatgctggaagttataagcaagttcgttctattggctccattgcacttagaaaagcagaggacattgacttcaagtaccactttgacttctttagtgtgaacttcaatgaagaactggtggctttgtatggtggaagtcttcagaagcagaccaagtttgtacatgaatgtattaaaacaattctcaaactctataagggtcaagaatttgctccaaaaagtgtggcaataattggtcattctatgggtggccttgttgcaagagcattgcttacactgaaaaattttaagcatgatctgataaatcttcttattacacaagccacacctcatgttgctcctgtgatgccattagatcgtttcattacagatttttatacgactgtaaacaactattggattctaaatgctcgacacataaatttaaccacactttctgtagctggaggattccgggattaccaagttcgttcaggattgacttttctaccaaaattaagccatcataccagtgccttatctgttgtgagttcagcagtgcctaagacctgggtctcaacagaccacctctccattgtgtggtgtaaacaattgcagttgactacagttcgagcattctttgatcttattgatgctgatactaaacaaataactcaaaattccaagaagaaactgtcagttttgtatcaccactttataagacacccatcaaaacattttgaggaaaatccagctataatttctgacttaacagggacatctatgtgggttctagtaaaagtgtccaaatggacctatgtagcttacaacgaatctgagaagatatattttacatttcctcttgaaaatcatagaaaaatctacactcatgtctattgtcagagcactatgctggatacaaatagttggatttttgcttgcataaacagcacttctatgtgcctgcaaggggttgatttatcatggaaagctgaactgctgccaacaattaagtatctgacattaagacttcaagactatccatctttgtctcatcttgttgtttatgtaccatctgttcgtggaagtaagtttgttgtagattgtgaattctttaaaaaagagaaaagatacatacagcttcctgtaactcatcttttttcctttggattgtcttcaaggaaagtggtgttaaatacaaatggcctatactacaatctagagcttctgaactttggacagatataccaagcttttaaaatcaacgtggtaagcaagtgctcagcagtcaaagaagaaataaccagtatctatagacttcatattccttggtcttatgaagattcactaaccattgcacaggctccatcttccacagaaatttctctgaaactccatattgctcaaccagaaaacaatacccatgtggcattatttaaaatgtacacgtcatcagactgtcggtacgaggtgacagttaagacttccttttcacaaatacttggacaggttgttgcttagaatatgctaccatgttggataaagaagccaaaccatacaaagttgatccttttgtaattatcattaagtttctgttggggtaagttttattatctgtgataatgattttaattgtgttttacatgtaacattatatttggttccataatgcaatataaattttcatacagatttggcagttgacttgtttcattaaatgaggtttttttttttctcttaggcaaaggtctaataagtatatcaatgtctacttcaatagtatcatttcaaaagtaattattcactttatgtatatcagtctaaacttagactgcctttaatgtttgtaaataggtgtatatggtccatgatctgtgagtatcctagattcaaacgcaaatcattacagggtattgatgaaacagtgcctctctgatcacttttaaaagtatattttagacctctctaccctagttaacattccattcttaatttagtcacattttcagatttttggttaagcatcaatatgtagatctttttttccatcattacaactaacttggctttcta

SEQ ID NO: 344191 - DNA, 512 bp, Homo sapiens
aagttaagattgccacctggaaactttgggctcctcttacctttaaggcaacaggctaagaaaggagttacagtgttatctggggtgattgaccaggactgtgaagatgaaatcagtctactactccacaacggagtagatggagatggtcaaggggttaccgccagtctgtttcttgcgctgataatttttctagacattaaatctcaccatttgttcccaacaaagaaagaaagacaggaccaccagactctacagggtgatctgacactaacaacttaacaaccattctactgagtcaacaaatttctcctctgtgtacagacttcaaccgaagaatctaatactactgtgaagtgctgctgggcaggacacacgttcaggagacacagtaggggaacagatgaggccagagtggcccacagccggggtgaagagcccccaattatttataaagtgtttgctgcctcatttatgaaaataaatagtgcaaagctgttacaagtattaca

SEQ ID NO: 344192 - DNA, 380 bp, Homo sapiens
gaggacattgaggtaaagctttcactatagaagtgcccacgagctcttccaaacatattttcctttttaaataagctctagatggagatggtcaaggggttaccgccagtctgtttcttgcgctgataatttttctagacattaaatctcaccatttgttcccaacaaagaaagaaagacaggaccaccagactctacaggtctagggatggatctggggatgctccacaaagtgcagctgtggagaatgcagaagaagagttggctagtgggacattcccactgaggagcatggcagggggaatgtctaatattcactaagagaattcttgaaatgtaacatttagatgaaactcttcaagtttccttaaaatacaaat

SEQ ID NO: 344193 - DNA, 331 bp, Homo sapiens
agtttgcaacccttcaaaatgccatcttttgcatgaagccttttttcatcaatccaacaggaagtatctgtcctccttctgaattatgaaagcaccttaatacctgttttgtggtacctatttcactttgtattttaagatccagacagccagactaccatgtaattcaagatctttacaagttgaactccctatctgcttcatcatcagctgggcaaacctcccatgtgctccagccacatgcggcaggtacattttcctagttcctggagtgctttctccacccctttcgatggggagaaaacctgagtatactttttttttttttttt

SEQ ID NO: 344194 - DNA, 556 bp, Homo sapiens
caaaattggccccttgcacccccccctggggccacaaaaagggaaccccctttcccccaaaaaaaaaaaaaaaaaaaaaaaaaaaaaaaaagaaaagaaaaatcctcagagcatgaacatcagcagctcttcttggatgaaaacattgatcagttaatttaaatggatagtattgtgattaataatccttttaagatttccctgactcagtttaatgtagctgtttggtggccctggagcagtcaaccaggagtgcacctttcaggtgcactagggtataaacgcacagagcccttagacaaagaagccaaacatttatccatcaagcactgatagtgggagctgcatttggggagtttgagcttcttaacagcaacattcttctttgtttgattgtttgctttggaagtctctgataagcgaaacttttttataagtggtttccatgaaccaggcttattactctcagataagaacaactcacattcatactttaaaagatgtctttaatctttttcagcagatgagagattctgcttaaacaaaaagtagaaaa

SEQ ID NO: 344195 - DNA, 602 bp, Homo sapiens
ttatacaaatgtgaagaatgtggcaaagcttttaagaaatcctcatccattactaaacaagataatttgtactggagagaaaacctacaaacgtgaggaatgtggcaaagcctttaatggtcccctcaactttctgcacataagataatttatactgtggagaagccttacaaatgtgaaaaatgtagcaaaccttttaactaatcctcaacccttactacacataagataattaatgctggagggaaatcccacccatgtggcaaagcttttaatcaatcctcaaaccttactaaacataagataactcatactggagaaaaatcttagaaatgtgaaggatgtggtaaagccgttatccagtcctcaactcccactaaacataacataattcatactggagagaaacctcacaactgtgaagaatgtggcaaagcttttaaccagtcctacaaacctttttgaacaaaataattcatacaggagagaaacactacaaatgtgaggaatgtgacaaagcctttaaccagtcctcaattcttaccaaacataagaaaattcatattggagattaaccttatgagtgtgaaaaatatggcaaa

SEQ ID NO: 344196 - DNA, 355 bp, Homo sapiens
tggcctggcaccaggcaggtactgtccctgggtaagcagcagtattggtaccaggctgggaggtgggatgcggggggcccttgctcccctcctccctcactggaaccctgagagcgactgctggacaccgtgcttagctgggagctcggagctcacagtgctggggaaggacccaagacctcaggtcctctcaaagtagcaagcattcttcctgctgcaggcctgttggggacaagggcctgagggacaaacagggcaggggctacttcaacccaattcctggcctgcctagcctcagctgccctccaatttttgtatttttttaattgatttttttgaaattttttagaaacag

SEQ ID NO: 344197 - DNA, 2882 bp, Homo sapiens
ctttcattcctttcctttccttcctttttcctctttctttctttccttttctctctctctctttttctttctctctttctttcgagatggagtctcgctctgttgccaggctggagtgcagtggcatgatctcggctcactgcaatctctgcctcccgggttcaagggattctcctgcctcagcctccctagtagctgggattaaaggcacgcactgccacgcccggctaatttttgtatttttaatagcgacagggtttcaccgtgttggccaggatggtctcgatctcctgacctcatgatccacctgcctcggcctccgaaagtgctgggattacaggcgtgagccaccgtgcccagccaggtctttttcttaaagagggacagactgaaggtaggctgtgaatggtcagttatttgtatttctttaccttttatgctatcttgtagtttgaccagtttgcaaaacaaattgaataaaaagtaattgataatgttgttttgatgctcagtgtttgagggaaacacaatctagtgaatggggttattggttgtcacacctgggagagtgaaaatgaggggctcacaacccaggtgaggtcatctggtgccactcagccccatcccagagaaagcagccttgggatgctggcctcggtgacaaccaagaagtgatggtgggttgctagagacagggtggagcacagagccctggaaggaagcaggaagtcaggttcaagaaaggacttgtgacctcacccttggcttcagggttttatttttctttcttttaaaacattttgagacaacatgtagacattcaaacttacagaacaaagaactattttttccctgaatcatttgagactaagttccctcctatcaccagacatttctacaaatgaggaccttcacaggactaaggtgccaccatcagaaccacaatatgtggggacggtactgccagctaagccttagtgctgtttcggtgttgacagctgtcacaatgatgcccttttcagtagaggagcctgtgatggtcacgtgttgcaggtgatcattgtgccatttggtttacttctgtctggaaagtttctcctttctgtaacctccatgaccttgacacatgaggtcactcttctcacccgccccacctctgggagggtgcctgatttgccctgccccacccagcggctttaggactcagctcttcaggaacaattagggagagggcccttgggtctaactgcaaaatcatacttgaactagaaaatcccgttggcataggtatggattgtcatatagaaacatttttcgcagtgtgccccgtggaacacttgttctgtatgttgttaacagatgttttgcaaaaaatgaaaaggacctgagctctaataagtttgggaaatgctgaattgaagtgaaacagcttttcttggtgtgagacctttcagagtctttaaaggagagttgctgaccacacgtgaaatcacaatagaaaatggccagcaggcctccaggtaggcagcaattcctagacatttgcctgtgttccctgggggagctggtggcctgtgaccatccactgggaaattcccttctgtggcgaggttctgttgttttccagaggctcccacggagcatgctgggtgggtggtctgtatgagaccacaccgttgatgagcagtgaggcccaaacaggtatatcaaaaaatgctcagcatcgctgatcatcagggaaatgcacatcataaacacagtgagacgttgcctcacacctgccagaatggctactgtcagacgaaagacaacaagtgtgggtgaggatgtggagaaaagcgaacacttgtccacctttggtgagaatgtaaattggtatagccattatggaaaacaggaagttcctgaaaaaattaagaacagctaccaggaatcccacatctgggtgtatatccaaaagaaatgaagtcagtaccttgaagagatctctgcagcccctgttcattgcagcattattcacaatagccaagatagggaaaaagcctcagtgtctactgacaaataaagatggatcaagaaaatgcatgtatgtatacacacacacagtggaataccaagtcttgcagaagaaggaaatcctgtcatttgtgacaacatggatgagctgagagaacattatgctaagtgaaataagccagacacagaaagaaaaataccagatgatctcacttatatgtggaatctaaaaaggttggactcagaagcagagagtggaatggtggttaccaaaggccagagggtgcaggaagtgagcagatgttggtgaaagggtgcagaggttcagctatgcaacatgaatgaattctggagatccactgtgcagcatggtgactatgatactgctttgtgtatttaaaattttcagagagtagatcttgtgttctttcccctctccaaataaaaggaaattatttgaggtgatggatatgtttaactagcttgactggggcaatgattttgtaatgataagtatctcaaaacatcatgttgtacaacataagtatacaattgacccttgaacaatacaggtttgaactctgtgggtccacttacatgcggttttttttttctgtaaaagttacacccgatgcgtcagccccttcttctacctcttccacctctggcacccttggcacagcaagaccaaccccccacttcctcctcctcctcctcagcctactcagggtaaagacaaggatgaagacctttatgatgatccacttccacttaatatataataaatatattttctcctcatgattttcttaaaactttttctgtattttattgtaagaatacagtatataatacatacaacatcg

SEQ ID NO: 344198 - DNA, 667 bp, Homo sapiens
ctttcattcctttcctttccttcctttttcctctttctttctttccttttctctctctctctttttctttctctctttctttcgagatggagtctcgctctgttgccaggctggagtgcagtggcatgatctcggctcactgcaatctctgcctcccgggttcaagggattctcctgcctcagcctccctagtagctgggattaaaggcacgcactgccacgcccggctaatttttgtatttttaatagcgacagggtttcaccgtgttggccaggatggtctcgatctcctgacctcatgatccacctgcctcggcctccgaaagtgctgggattacaggcgtgagccaccgtgcccagccaggtctttttcttaaagagggacagactgaaggtaggctgtgaatggtcagttatttgtatttctttaccttttatgctatcttgtagtttgaccagtttgcaaaacaaattgaataaaaagtaattgataaaaaaaaaaaaaaaaaaaaaaaaaaaaaaaaaaaaaaaaaaaaaaaaaaaaaaaaaaaaaaaaaaaaaaaaaaagaaaggagagaggagcgaggcgagcaaaaaaaaaaaagaggagaggagggaaaaaaaaagggacaattaaggggcccgcggggttaatggcggggggggc

SEQ ID NO: 344199 - DNA, 599 bp, Homo sapiens
ggcatgtatctattctaaaaatattattcagagtctcttcttcacaaaacgaaagaaagacccctctatcttaaaaaagtactagaacacatgaaacaaaagaccctccatatctatgagaagataaggctaaattttcaagttctttttttaattactaaatcacttcaaacagtttccaaacataatagggacaatatggtgtgactcttgatgttggcttctacaattagtgtgttattaattaaactcttgagtactataataacttgacagttaaagcccttctttgcatttaaagtgcatgcaaactgtggctccaattataaataaactctactgcgatgggcttaaaactgcaaatttaattattcagagcaaattgttcaatctatgctctattctggaggatgcttcctgaatattctcgtgtgctcgatatgaatgggggtctaaagtagggttccatagcataggcctgcttgcgcatctctctgccccagcttccctaccctccctgctactgctccaaactggaaattcacgtgggttttccaggcatgcctcattcagtccactctccttcaccatggcgctgc

SEQ ID NO: 344200 - DNA, 205 bp, Homo sapiens
tagaagaaaacaaaatatatacatatttcaatgaagagcagagataatttcccaattgaaatggggataatagaaattattctattgaagcaatagaaatgtatcaattataaagtatttgagtttaatgctattaaatttgaaatgctacaggaagggaaaaaagattaaaagcaacagagtaggggaaaaattttaactaaca

SEQ ID NO: 344201 - DNA, 520 bp, Homo sapiens
acagttgagactaccatgcaactagctaacgacaccacacaggaagaaaacctcaaatatcaatattaaccttgaatgcaaacaatgtatacactccacttaaaagacactgagtggcaaactggatgaaaaaacaagacccatccttctactgtcttcaagagagcaatctcacatgtaatgacacacaaaggctcaaagtaaagatctatctatacagaaagatctttctcaaagtaaagatctatctatacagaaagatctttctcaaagtaaaaatctttctatagagaaagatctatcatgcaagtaaaaacaaaaaagggcagaggttgttattcctatatcagataaaatagactttaacaataaaaaggacaaaaagtaatattacataatgataaagggttttattcaacaaataaataggcacccaacattggagcacccaaatctataaaacaattacttctagacctaagaaaagacttatatagccacacaataataagggaagaat

SEQ ID NO: 344202 - DNA, 467 bp, Homo sapiens
tgatgggggctgatgggagtgagagtgcaccatcccctgtgatactcgctgtgtgtattttcctggaggctcagtagcttgtttgtctccaaaggaattaagttccacatgagccagttttcataataaacctccttttatgtatctttatcctattctgtttgtctgcagaacactaatacagatttggtactgggagtggggtcactgatgtaagtaccagagtctgagggctcccatgtccacaggcaggagaagatcaatgtcccaacttgagagaatttgccctccttctgtcgttttgttctatttgggcccttaatggattgggtgatggcctacccatataggtgagggcagaccttctgtactcagtctgattccagtgccaatctcttccagaaacgccctcgcagacacacccagaaagaatgttttaccaggtatctggacatcctttggctcag

SEQ ID NO: 344203 - DNA, 425 bp, Homo sapiens
actttagaaagaagttggaagaggaaacattaggaatttcctttcaaactccaatcaaaacagcccatttgaatatttttttaaaaaaattccaaaaattcttcctgtgaggatgcattggctaaagcaggtcaaagttgctgaagaggactaagcgagcctcttggggaagatgatatcatctgatctgtacacatgtcacattcagaacattctgcatggctgctgctgagctcccatctgtcagatctcaacagagagaacaaagactagagatgtgagtaattcaagaaacatccatttactagctgaaaaaacaaataaaattaggaggagccactttcttcttgttacatgttactgatacgtgttctacctggccataccacacattacataaaatgtattcaactactttactgtca

SEQ ID NO: 344204 - DNA, 411 bp, Homo sapiens
cgcaaaatgctttaggctgtatggcctgatctctttccagctttagaagaggtgcctggattagcctggaaaggttgctcacagagagggaggccgagtttcagatccctggatggtagaacaggaaaaagcccatgagttctgccttccagccagccccgggcctgtgtagccctgtctcccttcatctcctggggcccaggccggatgggagagtggtgagaaggtgtcctccaggtttgagagtgagagatttcagcagtggggagcagagtcccagtgctcactctgggtggggctgtgggagagaactcgtgtgcaccacgctgtttgcccttgatgtattttctcaggttctgacattcttgccttctgaactttcgagtaagacgtgggagaaaccagcaagag

SEQ ID NO: 344205 - DNA, 349 bp, Homo sapiens
acattttatgatcttcatctgtagcgcaaaatgctttaggctgtatggcctgatctctttccagctttagaagaggtgcctggattagcctggaaaggttgctcacagagagggaggccgagtttcagatccctggatggtagaacaggaaaaagcccatgagttctgccttccagccagccccgggcctgtgtagccctgtctcccttcatctcctggggcccaggccggatgggagagtggtgagaaggtgtcctccaggtttgagagtgagagatttcagcagtggggagcagagtcccagtgctcactctgggtggggctgtgggagagaactcgtgtgcaccac

SEQ ID NO: 344206 - DNA, 856 bp, Homo sapiens
cgtcggagggcgggacttccgccgtcctcctggtggtggtcgttttggttctgtgtggtgtttcaccaacttcggcctatggctctgtctgacgtcaccgaagtgacggaacggaaaagcgcgagaagcggctcggttcccaccacggagaggcgggagtgagtcaactgacaagcgctggggacagtggcgtccttgtcttgcctttgtcgctcccgccccgctcttccctggctgggctggcggaggccttgctgatgaacctgactgagggtcccctggcgatggcagaaatggaccctacacagggccgtgtggtctttgaggacgtggccatatatttctcccaggaggagtgggggcaccttgatgaggctcagagattgctgtaccgtgatgtgatgctggagaatttggcccttttgtcctcactaggttcttggcatggagctgaggatgaggaggcaccttcacagcaaggtttttctgtaggagtgtcagaggttacaacttcaaagccctgtctgtccagccagaaggtccaccctagtgagacatgtggcccacccttgaaagacattctgtgcctggttgagcacaatggaattcatcctgagcaacacatatatatttgtgaggcagagctttttcagcacccaaagcagcaaattggagaaaatctttccagaggggatgattggataccttcatttgggaagaaccacagagttcacatggcagaggagatcttcacatgcatggagggctggaaggacttaccagccacctcatgccttctccagcaccagggccctcaaagcgagtggaagccatacagggacacagaggacagaga

SEQ ID NO: 344207 - DNA, 617 bp, Homo sapiens
cgtcggagggcgggacttccgccgtcctcctggtggtggtcgttttggttctgtgtggtgtttcaccaacttcggcctatggctctgtctgacgtcaccgaagtgacggaacggaaaagcgcgagaagcggctcggttcccaccacggagaggcgggagtgagtcaactgacaagcgctggggacagtggcgtccttgtcttgcctttgtcgctcccgccccgctcttccctggctgggctggcggaggccttgctgatgaacctgactgagggtcccctggcgatggcagaaatggaccctacacagggccgtgtggtctttgaggacgtggccatatatttctcccaggaggagtgggggcaccttgatgaggctcagagattgctgtaccgtgatgtgatgctggagaatttggcccttttgtcctcactaggttcttggcatggagctgaggatgaggaggcaccttcacagcaaggtttttctgtaggagtgtcagaggttacaacttcaaagccctgtctgtccagccagaaggtccaccctagtgagacatgtggcccacccttgaattccattgtgctcaaccaggcacagaatgtctttcaagggtgg

SEQ ID NO: 344208 - DNA, 360 bp, Homo sapiens
ttggttctgtgtggtgtttcaccaacttcggcctatggctctgtctgacgtcaccgaagtgacggaacggaaaagcgcgagaagcggctcggttcccaccacggagaggcgggagtgagtcaactgacaagcgctggggacagtggcgtccttgtcttgcctttgtcgctcccgccccgctcttccctggctgggctggcggaggccttgctgatgaacctgactgaggtgggtgtcccgtcccaggctcccccgcccgaccggtcctcccagtgctgaagccccctgaaggggccctgcaggtcaggccccttgtcccgaagagaggggcgttcctgtgtggggtccccgtatcagccg

SEQ ID NO: 344209 - DNA, 820 bp, Homo sapiens
cgtcggagggcgggacttccgccgtcctcctggtggtggtcgttttggttctgtgtggtgtttcaccaacttcggcctatggctctgtctgacgtcaccgaagtgacggaacggaaaagcgcgagaagcggctcggttcccaccacggagaggcgggagtgagtcaactgacaagcgctggggacagtggcgtccttgtcttgcctttgtcgctcccgccccgctcttccctggctgggctggcggaggccttgctgatgaacctgactgagggccgtgtggtctttgaggacgtggccatatatttctcccaggaggagtgggggcaccttgatgaggctcagagattgctgtaccgtgatgtgatgctggagaatttggcccttttgtcctcactaggttcttggcatggagctgaggatgaggaggcaccttcacagcaaggtttttctgtaggagtgtcagaggttacaacttcaaagccctgtctgtccagccagaaggtccaccctagtgagacatgtggcccacccttgaaagacattctgtgcctggttgagcacaatggaattcatcctgagcaacacatatatatttgtgaggcagagctttttcagcacccaaagcagcaaattggagaaaatctttccagaggggatgattggataccttcatttgggaagaaccacagagttcacatggcagaggagatcttcacatgcatggagggctggaaggacttaccagccacctcatgccttctccagcaccagggccctcaaagcgagtggaagccatacagggacacagaggacagaga

SEQ ID NO: 344210 - DNA, 1120 bp, Homo sapiens
cgttcatctattatttttgcccccattatcctcctttctgtgtaaacattaattcattttctcccatctttcctacccagcagatcttaaagagaggaagagtttgtaatattcttcaggggaagccttttgagattgaaatatcatactttgaatgataactctatatctatctataatatactatggtttaatgtttggaaatcaaacgcagtatttatttgtcatgtgaactactaaaagtaaatctgcatggacttcttgcctggtgagttacacagaaaatgaaagtgattatcagtggctgtggcaagatgaaaggaaccatgccaggacttctgagggaaggaagagtgtttgggactgaaaaatccttgtctggatctagtcctcagccactcagaagctggcatgccatgactcaaagagccgcccgtctggaatgaagacagtgacccgtaactcccacctgaagagcaggtgcttggaaaatgctgccagtccgcaggaaaaagttgttactgctgctgtctgtgaccaagaggacactttatttcttgaaacaactgggggcaaactggctcccagataaggcttcagtccctactcatgtgaggaaaccagccctgcacctgagagtttattcagtgacgataatactcacaagaccctttttggatttgtggcccaacccacaagttatagttccttctctgaatatttcatccagattgtgaagagcagcttctggcagccacagttgtactatgtgacccctacttcccatgcccaggactgattcgaccccgtagtagacacctaaagcaatcctgatcagtcagagtctttgttcctgacatttgggattagagcatggctgaaggtttaagacacaaacttggaagctgtggggcagcaatacacctccatgaggacagagaagcaggggaaataagaataaaccagaagctcacagaaacgcaggaaatacttctagagttctaacacttttcgggtttcttgttctagtccattcttgacacacttgtgcctcacagaagccaatggcaagaatgcagtcagatccttccaataaattccttttattctgtttacatta

SEQ ID NO: 344211 - DNA, 254 bp, Homo sapiens
caatattacagctatagtcaaggttaacttgatgtttcctttataaaacttgatttttttggaaagggggtgaaatatcttggacattaaaaatttattgtacaaaactatatgttactagttttctggcactgaaatattcatttctatttatatgtacctacctttagaatagtcagaaacttaattgtagagttatgtttaccatagtacattttcaatcgcattgtgaatttattctattttttttttct

SEQ ID NO: 344212 - DNA, 3054 bp, Homo sapiens
gccgagttcttatttttacggagggcttgtggccttagacgccagtttgcttatggaaatgaaacagaatagtccctgttcaaggatgtgtttcatgacagcacgagtgtaaatgagtgcccacacattttaacagccttgggcaggattttgctgctgagatccctagagcagctggttcttggctcattcttggggtagaggccgtggatcagggctgggggcaggggtgacaattgagaagtgcactgagccctttcctgttaacaattgggcatagaaagcaggattagtacttcctggttatacacttattttgtaaaaatagaattaatatcacagcaaccaatgtgtaggtttaagaaagtggccaggtgcagtggttcacgcctgtaatcccagcactttgggagggcggggcgggtggatcacgaggtcaggagctcaagaccagcctggccaagatggtgaaaccctgtctctactaaagatacaaaaattagccgggcgtggtggcgagcacctgtaatcccagctactcgtgaagccaaggcagagaattacttgaacccaggaggcggaggttacagtgagctgagatcacgccactgcactccatccagcctgggcgacagagcgagactcaaaagtatgattctggctgtagagttttctttttttctctgtctcaaaaaaaaaaagtgtcagcttggtcttgtcaagaggtgaaggaacttgttttattcttttattttttttttaagatagagacgggggtcttactatgttgcccaggctggcctcaaattcctggtctcaggcaatcctcctgcctcggcctcccaaagtgctgggatcagttgtgagccacactacccagccaaactccagttttagttaaactgtttcacctcatttttatgctgagttttgtaaagtaggtattcttgctgaacagagtcctgaaaatcaaactatacaagtagtaggaagtccattaagctgtttagaggaaaaagtgttataaatggcagttaaatgaacccaggaaagacccatcctcctttgtggctttctctgaggccccatgaggccaagcagaagcaaactggctctaggtgcagccagactttgaaaaggaatcccggccaggcttggtggctcatgcctgtaatcccagcactttgggaggtcaaggcaggcagatcacctgaggtcaggagttcaagaccagcctggccaacatggcgaaacactgtttctactaaaaatatgaaaattagctgggtgtgctggtaggcgcctgtaatcacagctacttgggaggctgaggcgggagaatcgctcaaacctgggaggcagaggttgcagtgggctgagatctcgccactgtactccagcctgggcgacagaccaaggctctgtctcaaaaaaaaaaaaaaaaaaaaaaaaaaagggaatcccaaccagatactggtgcaaggtcagagatgcagccaatggggagatttgtagaaagctcatagatgctaaaaacatgggtctttaggaaaattagaattcagctgagcctcctttcatttggacaatgttcagaagctcttacagggggctatggcaatcttttgatgcttcttatagctttctgaggttaacgcttttgtggtgggcatcggtagcaataaaatgcaaactttattgcatttccagtaaaatctctcccactttgagcaggaagcactcacaaaaaacgcatatacatgtcaacgttgtgagctcatcagagttttagaaatcaacttccacagtgaaagccaatgtaggcagaaggtttataacagaatccccaggcagagaagtgaatttcagagcatttcagggaggaaactcctctgcacatgtcagcatgtttaacatcgatgatggcaggttgtgtgctggcagccagagtctgaggccactgtccaaagttcagcgtcagtggttcctgttgctggtcatggagagagacaactggaaagtcaggtgtcttcacgctctaactagagcacagggatggaccatagccatgctaacctttgttaacccctaggacttgtcaaggtgtttaagcagtaggaatgaggaaacaacgttctgattcaagtaaatgtaactagaagtaaaaatttaaaaacttgtaagctcactaaagtgaagctctgcagacacggttcatatcctggtggctgagggcacataaccaagaacttacacaagcacccccaagccacaaagatcccagctgctatggttgaggggtaacctgccagcactggagccaagtgttggagctactgatccaaagttagctcacttctgcagaggctctgaaccagagcaaagaaatggcccagtgcaagcccagtgtgagccaagagttggccatgtaatcagttctggcccaaccaggtttgaaaggtagaggagcagtactgggttttggagagggaaggttggaacaaagccctttgcaggctataagcttcatttactaggccaggtctttctgtgtgaatgtgctttgactttggtctgtttatatgcatggggtaaacgtgggacagcctctgcagcttcactgcctgccggacgtgggtccagggctgccagctctgggtccttggtctgttgggggtcgcaaactgaaatggccatggggctatctgggcaggcaacacagatgagtggggatgggggaccccttctgtacagagcagcctctacttagtggccgctgacaggctgccccatgaggacgcaggcccaacattacctaatttaatcttctagaagtcagaattctgaatttttatgtcaactctcgactttttttttttttttgagacagagtcttgctctgtcgcccaggctggagtgcagtggcgcgatctcggctcactgcaagctccgtcccccgggttcacgccattctcctgcctcagcctcccaagtagctgggactgcaggcgcccaccaccacgcccggctaatttttttatttttagtgagacg

SEQ ID NO: 344213 - DNA, 2796 bp, Homo sapiens
gccgagttcttatttttacggagggcttgtggccttagacgccagtttgcttatggaaatgaaacagaatagtccctgttcaaggatgtgtttcatgacagcacgagtgtaaatgagtgcccacacattttaacagccttgggcaggattttgctgctgagatccctagagcagctggttcttggctcattcttggggtagaggccgtggatcagggctgggggcaggggtgacaattgagaagtgcactgagccctttcctgttaacaattgggcatagaaagcaggattagtacttcctggttatacacttattttgtaaaaatagaattaatatcacagcaaccaatgtgtaggtttaagaaagtggccaggtgcagtggttcacgcctgtaatcccagcactttgggagggcggggcgggtggatcacgaggtcaggagctcaagaccagcctggccaagatggtgaaaccctgtctctactaaagatacaaaaattagccgggcgtggtggcgagcacctgtaatcccagctactcgtgaagccaaggcagagaattacttgaacccaggaggcggaggttacagtgagctgagatcacgccactgcactccatccagcctgggcgacagagcgagactcaaaagtatgattctggctgtagagttttctttttttctctgtctcaaaaaaaaaaagtgtcagcttggtcttgtcaagaggtgaaggaacttgttttattcttttattttttttttaagatagagacgggggtcttactatgttgcccaggctggcctcaaattcctggtctcaggcaatcctcctgcctcggcctcccaaagtgctgggatcagttgtgagccacactacccagccaaactccagttttagttaaactgtttcacctcatttttatgctgagttttgtaaagtaggtattcttgctgaacagagtcctgaaaatcaaactatacaagtagtaggaagtccattaagctgtttagaggaaaaagtgttataaatggcagttaaatgaacccaggaaagacccatcctcctttgtggctttctctgaggccccatgaggccaagcagaagcaaactggctctaggtgcagccagactttgaaaaggaatcccggccaggcttggtggctcatgcctgtaatcccagcactttgggaggtcaaggcaggcagatcacctgaggtcaggagttcaagaccagcctgccaatggggagatttgtagaaagctcatagatgctaaaaacatgggtctttaggaaaattagaattcagctgagcctcctttcatttggacaatgttcagaagctcttacagggggctatggcaatcttttgatgcttcttatagctttctgaggttaacgcttttgtggtgggcatcggtagcaataaaatgcaaactttattgcatttccagtaaaatctctcccactttgagcaggaagcactcacaaaaaacgcatatacatgtcaacgttgtgagctcatcagagttttagaaatcaacttccacagtgaaagccaatgtaggcagaaggtttataacagaatccccaggcagagaagtgaatttcagagcatttcagggaggaaactcctctgcacatgtcagcatgtttaacatcgatgatggcaggttgtgtgctggcagccagagtctgaggccactgtccaaagttcagcgtcagtggttcctgttgctggtcatggagagagacaactggaaagtcaggtgtcttcacgctctaactagagcacagggatggaccatagccatgctaacctttgttaacccctaggacttgtcaaggtgtttaagcagtaggaatgaggaaacaacgttctgattcaagtaaatgtaactagaagtaaaaatttaaaaacttgtaagctcactaaagtgaagctctgcagacacggttcatatcctggtggctgagggcacataaccaagaacttacacaagcacccccaagccacaaagatcccagctgctatggttgaggggtaacctgccagcactggagccaagtgttggagctactgatccaaagttagctcacttctgcagaggctctgaaccagagcaaagaaatggcccagtgcaagcccagtgtgagccaagagttggccatgtaatcagttctggcccaaccaggtttgaaaggtagaggagcagtactgggttttggagagggaaggttggaacaaagccctttgcaggctataagcttcatttactaggccaggtctttctgtgtgaatgtgctttgactttggtctgtttatatgcatggggtaaacgtgggacagcctctgcagcttcactgcctgccggacgtgggtccagggctgccagctctgggtccttggtctgttgggggtcgcaaactgaaatggccatggggctatctgggcaggcaacacagatgagtggggatgggggaccccttctgtacagagcagcctctacttagtggccgctgacaggctgccccatgaggacgcaggcccaacattacctaatttaatcttctagaagtcagaattctgaatttttatgtcaactctcgactttttttttttttttgagacagagtcttgctctgtcgcccaggctggagtgcagtggcgcgatctcggctcactgcaagctccgtcccccgggttcacgccattctcctgcctcagcctcccaagtagctgggactgcaggcgcccaccaccacgcccggctaatttttttatttttagtgagacg

SEQ ID NO: 344214 - DNA, 2583 bp, Homo sapiens
gccgagttcttatttttacggagggcttgtggccttagacgccagtttgcttatggaaatgaaacagaatagtccctgttcaaggatgtgtttcatgacagcacgagtgtaaatgagtgcccacacattttaacagccttgggcaggattttgctgctgagatccctagagcagctggttcttggctcattcttggggtagaggccgtggatcagggctgggggcaggggtgacaattgagaagtgcactgagccctttcctgttaacaattgggcatagaaagcaggattagtacttcctggttatacacttattttgtaaaaatagaattaatatcacagcaaccaatgtgtaggtttaagaaagtggccagaagtgctgggatcagttgtgagccacactacccagccaaactccagttttagttaaactgtttcacctcatttttatgctgagttttgtaaagtaggtattcttgctgaacagagtcctgaaaatcaaactatacaagtagtaggaagtccattaagctgtttagaggaaaaagtgttataaatggcagttaaatgaacccaggaaagacccatcctcctttgtggctttctctgaggccccatgaggccaagcagaagcaaactggctctaggtgcagccagactttgaaaaggaatcccggccaggcttggtggctcatgcctgtaatcccagcactttgggaggtcaaggcaggcagatcacctgaggtcaggagttcaagaccagcctggccaacatggcgaaacactgtttctactaaaaatatgaaaattagctgggtgtgctggtaggcgcctgtaatcacagctacttgggaggctgaggcgggagaatcgctcaaacctgggaggcagaggttgcagtgggctgagatctcgccactgtactccagcctgggcgacagaccaaggctctgtctcaaaaaaaaaaaaaaaaaaaaaaaaaaagggaatcccaaccagatactggtgcaaggtcagagatgcagccaatggggagatttgtagaaagctcatagatgctaaaaacatgggtctttaggaaaattagaattcagctgagcctcctttcatttggacaatgttcagaagctcttacagggggctatggcaatcttttgatgcttcttatagctttctgaggttaacgcttttgtggtgggcatcggtagcaataaaatgcaaactttattgcatttccagtaaaatctctcccactttgagcaggaagcactcacaaaaaacgcatatacatgtcaacgttgtgagctcatcagagttttagaaatcaacttccacagtgaaagccaatgtaggcagaaggtttataacagaatccccaggcagagaagtgaatttcagagcatttcagggaggaaactcctctgcacatgtcagcatgtttaacatcgatgatggcaggttgtgtgctggcagccagagtctgaggccactgtccaaagttcagcgtcagtggttcctgttgctggtcatggagagagacaactggaaagtcaggtgtcttcacgctctaactagagcacagggatggaccatagccatgctaacctttgttaacccctaggacttgtcaaggtgtttaagcagtaggaatgaggaaacaacgttctgattcaagtaaatgtaactagaagtaaaaatttaaaaacttgtaagctcactaaagtgaagctctgcagacacggttcatatcctggtggctgagggcacataaccaagaacttacacaagcacccccaagccacaaagatcccagctgctatggttgaggggtaacctgccagcactggagccaagtgttggagctactgatccaaagttagctcacttctgcagaggctctgaaccagagcaaagaaatggcccagtgcaagcccagtgtgagccaagagttggccatgtaatcagttctggcccaaccaggtttgaaaggtagaggagcagtactgggttttggagagggaaggttggaacaaagccctttgcaggctataagcttcatttactaggccaggtctttctgtgtgaatgtgctttgactttggtctgtttatatgcatggggtaaacgtgggacagcctctgcagcttcactgcctgccggacgtgggtccagggctgccagctctgggtccttggtctgttgggggtcgcaaactgaaatggccatggggctatctgggcaggcaacacagatgagtggggatgggggaccccttctgtacagagcagcctctacttagtggccgctgacaggctgccccatgaggacgcaggcccaacattacctaatttaatcttctagaagtcagaattctgaatttttatgtcaactctcgactttttttttttttttgagacagagtcttgctctgtcgcccaggctggagtgcagtggcgcgatctcggctcactgcaagctccgtcccccgggttcacgccattctcctgcctcagcctcccaagtagctgggactgcaggcgcccaccaccacgcccggctaatttttttatttttagtgagacg

SEQ ID NO: 344215 - DNA, 759 bp, Homo sapiens
ggctcttgggtccctatgtggctgttgctcccctctgggcctctgcttggccttctgtgaagggcacaaagagtccagtgggaccacatgaaggtcactctccatgtggagtggagagaccgcctgggagagatggctgagggcctgctggggaccaaagtctgagctcataaagaaaagccagcagttcctctgttgctcttttcctttacagaattagttacattgtcataattaaagaaaactcaagggctgggctcagtggctcatgcctgtaaacccagcactttgggaggccgaggagggcggattgcctgagatcaggagttcaagaccagcctggccagcatggcgaaaccctgtctctacttaaaaaaaaaaaaaaaaaaaaaaaaaaattagctgggtgtggtggtgcacacctggaatcccagctgtcaggaggctgaggcaggagaatcgcttgaacctgggatgggagactctgtctcaaaacaaaaacaaagaaactcatgtgaaagaaggcaacatttccccccaacacaaggaagctccacagtcccctgggaggacccaaggatgcaggcgccccagaccctgctggcaggaggacacagtgtctgttgggaggtcatcctgctgtgtctgttaactataaattgcaggtcacatttgagtgttgcttagcccttcgtcctgaagttacttgcagtttgtccaggcacgcgccaacaaggactgctccaaccttgtcaaagc

SEQ ID NO: 344216 - DNA, 744 bp, Homo sapiens
ggctcttgggtccctatgtggctgttgctcccctctgggcctctgcttggccttctgtgaagggcacaaagagtccagtgggaccacatgaaggtcactctccatgtggagtggagagaccgcctgggagagatggctgagggcctgctggggaccaaagtctgagctcataaagaaaagccagcagttcctctgttgctcttttcctttacagaattagttacattgtcataattaaagaaaactcaagggctgggctcagtggctcatgcctgtaaacccagcactttgggaggccgaggagggcggattgcctgagatcaggagttcaagaccagcctggccagcatggcgaaaccctgtctctactaaaaaaaaaaaaattagctgggtgtggtggtgcacacctggaatcccagctgtcaggaggctgaggcaggagaatcgcttgaacctgggatgggagactctgtctcaaaacaaaaacaaagaaactcatgtgaaagaaggcaacatttccccccaacacaaggaagctccacagtcccctgggaggacccaaggatgcaggcgccccagaccctgctggcaggaggacacagtgtctgttgggaggtcatcctgctgtgtctgttaactataaattgcaggtcacatttgagtgttgcttagcccttcgtcctgaagttacttgcagtttgtccaggcacgcgccaacaaggactgctccaaccttgtcaaagc

SEQ ID NO: 344217 - DNA, 459 bp, Homo sapiens
attaccaggtatggaacactttgtctttcttgaattggccacaccgatagaacagccatgttccaacccagactgctggctccaaggcaacagtttctgttgagaagatgcttgttgtggttgatctctctagtcattactctatagccgtgaagagcagacatgcctggtgcctgggtcaagctgtccctgcaggccttggggacactgcatgaaccaggccaggtgtagggggtctctcttgctttggccttggagagtcctctctggggtggaagtggaccagcatcaagggtctgctcatatacagtttttcttcttttaattataatctctcagtactttaggccacccttttcctgcgcgttctcaaatgaaaagacactgatgtcttagccaataggagagagcagtttgccctcatgacattcctttctcactagaacctcaatcttgtta

SEQ ID NO: 344218 - DNA, 638 bp, Homo sapiens
tccctctactggtgtcccaaacatcatccttctcatctacttaaaggtatcagttcatcagttcatacctttttttctctttgatcattaccctttgtcctttctccccactggattgttgtggcagtcttgagaatgcacatcccagcccctcagctagaggaagcacaactgatgatgctccagctgttgccgcctgaaatctattgctacgtttgctctcagaccatacttgccattggcttcttcgattcaataattgagagaagaggagaaacaaagacaggattgtccctcctttaaaggcccactgaggctccagggctcacccttactgaacttctcttaacctgcactgggtctaggatactttcagccaaacttccttccctctctccttcactggggtttaaacttgcattgcagtctggttgggcacagtggctcacgcctgtaatcccagcactttgggaggccaaggtgggcagatcacatgaggtcaggagtttgagaccggcctagctaacatggtgaaaacccgcctctactacaaagacaaaaatttgccaggtttggtggtgcatgcatgtaatcccagctacttgggaggctgaggcatgagaatcacttgcacctgg

SEQ ID NO: 344219 - DNA, 476 bp, Homo sapiens
cttaaaagaacctagccttcctagctcactttatcacgagctcaaaaatatacatccaaggacgtccattttcacatccttacgtgaaatccagatgtgcatcactcacttctcgcccatattaacacaaaaattcagcttctctttgtaggttccaaaagtaattatattctcactgaaagtattagtaagcaaggtagtgtttgcaatatgcaaggtagcatatctcagaggggagaaggaagactaagtttacattcattcagtgtgcatcattttttttgtttgtttgttttccaagctggagtgcagtggcatgatcatggcttcactgcagccttgaactcctgggctcaagcaatcctctggccttagcctcccaaggagctaggactacaggcatgggccatcgtgactgggctgattttttaaaaattatttttagtagagatgagatcttgttatgttgcccaggt

SEQ ID NO: 344220 - DNA, 474 bp, Homo sapiens
atgtattttcatttcattgagtgtatacctaggagtagaattgctaggttatatggcagtcctatgtttaaccattcgaggaattgccagacaatttttcaaagggatttgctccatttcatagtcccaaccagctgtgtacaagggttctcatttctccacgtcctggtaacactaattgttactgttttttttttttttttattatagtcatcctagtgagtgtgatatagtagttcattgtggttttgatttacattgacctgatggctaatgatgttttcgtgtgcttattggccatttatatcttcactggataaatgtctattcagatattttgtttatttttaagtcatattatttgtctttttattattgaattctaagagttctttatatagtctagatacaagcctattaccagatatatatgatttgcaaatattttttcccattctgtaggttgtcttttca

SEQ ID NO: 344221 - DNA, 223 bp, Homo sapiens
gttaagtttaaagtccaacaaaaatgagactacactgtttgcttttaaaactgtaaaatgaaatccaaagcaagacgtagcaaagaaccagcttcagtggtactgcagttctttatcctagcacagtatgtttctatgaactgcaccactgtagctgaacaggcatctaccaaacagaccactatgatcaagacaactttatttacttatttatttttgagac

SEQ ID NO: 344222 - DNA, 609 bp, Homo sapiens
aaattcgctgccgtcagacctttcttttttttttttggagacgcttttcactcttgtttcccaggctagagtgcagtggtgtgatctcggctcactgcagcctccgccaccacccacaattagaattctcaaagcaaacaggcctcagccttgaattgattacactaaagtagtgtttccacacttggtctaactaataatatacatatactactaacatacaaattctaggactccatcccacatctacagaatcttaatctctagggaaggagtttgggaatctctaagtttaacagtcaccttcagtgactaatacaacctggcaagttttggaaagaatgcatagaaggaaaataaatttaatcccaagaggagctagtttactcctaaagtatctccagatggtagaaatgtatgatataggaatttctgaatagcaaatcttcactgctatgtgaccttgaatgagttacttaaacttgctaaatctcagtttatttataaaaaggagaatactctttgttctggcaaaattaagggtgcaagaataaaactatatatgttggcatttattaaatattagtttctttccttttctactctaag

SEQ ID NO: 344223 - DNA, 90 bp, Homo sapiens
tcatttagacaggatggataacagggaaaagctagattatcaagtgcttggcagctgatataaataaatactaaataattcttatgccaa

SEQ ID NO: 344224 - DNA, 305 bp, Homo sapiens
ggccagcatgctttttaagatgtcaaaactgcataaaatagagaaaataaaaaacatggtaaatgcagatatccacttgttttgataccatttgttgaaaacactatgccattttcattaaattgcctctgcatcttggtaaaaatcagttgaccatatttgtaggtgtctacttgtttattttctattttgttgcactgaagtacttgctgtctttttttttaatgctttaagttctaggatacatgtgcacaacgtgcaggtttgttacataggtatacatgtgccatgttggtttgctgcac

SEQ ID NO: 344225 - DNA, 354 bp, Homo sapiens
agctggccaccccccaggagacatccctgatccctcattttctctctagagccacctcctgtcccttagcaaggcctgctggctctgcctccacgtcttttccacagctcccccatactcctgcgtcctccaccagcccccaagccctttccccctccacctgcagggttgcatggcctcctaaccagctctccacctcacacatgtgccctgtggtccaccgctctccctacaacagagtaagcttcagctcagacctacccttggtcaaaaccagtggtttccatgtgcatgagaattagacacatccttacaatgtccttcaaggcacaatgaaatccaccagccacctcc

SEQ ID NO: 344226 - DNA, 211 bp, Homo sapiens
tacaagctcctcaagaacaacaaatacttaacagatttggggcaaaaaatactcatttgccactatatacggatacaaagaaggatgaagacacaaattacttcttttaggagcttacaagtttacaagtctaattcaaacacacataaaactatttatggccttagaagtcaggagagtgtttactgttgtggggaagcagacactggaa

SEQ ID NO: 344227 - DNA, 785 bp, Homo sapiens
tctttggggttagggcttcatcatctacaactttaggggacacaaggcagttcatagcagttgctctcctttggtttgtatccaactacactgcctggttgatcttctctctgaatatttcggtgctatctctttccttcagtttgcatcttcccctctcagaaatgtatgtcaatctaaaagtccaatcccatccactttctgtattggtcatttcatcatcttccagggcttcatccatgacttgcacctgtgtgaccccaacttcggacctgccttctctcctggtcctgcttattcactcccccgcatccctctggccacctccaacaaaggaaaccttccccatgaccacaaaggaatttccctttgatttattcatttatttttcaatatcatgactgtattagtttcctaggactacaaaaaaaaaataccatgaactgactggtttcaaacaatagaaatttatttcctcacagttctgaagtctgcaaatccaaagtcacagcgtcagcagggctgtgctgactcagagggctgcggggagggtctctgtcagtactctggggagggtccctgtcaggcctcccagcacctggtgttgcctgcggtccttggctccttggcatccttgacttgcagaagtctcactccatccagtccctccctctagcgacatgtgacttttgccctgtgtgtgtctttgcatttcttctcctcttctaataaagccaacagtcatattggatgaagggcccaccttatttcagtatgacctcatg

SEQ ID NO: 344228 - DNA, 535 bp, Homo sapiens
ctaaataaacgtctgcttgaagcacttttatttgccagtagaagtaatatttccaactgtctcaggtcaagagttccttttggcctccagcctgatctcagactggactttcctctttgggaactcctatgccctctactcagaagactgtcctcttggcttcttttggcttttcagcaacattgacatttgtcttctgtattattattatatagtttgtttatttatttttactttttacagatatgaggtcttgccctgtcatccaggctgaaatacaatcatggctcactgcatcctcaaccttctgggctgaagcgacactcctgcctcagcctcccaagtagctgggaccataggaaagcatcttattttttttcattttttagttctctttcttattcttttgccacaagttgataattgaggccgatgcaagtgaagacatagatacatgccacagttaggattgtgtcatatacacagaacatgtgtttgtcattttcttttctttttttttttttttttgagacag

SEQ ID NO: 344229 - DNA, 119 bp, Homo sapiens
gattctctttttccatttcagtgaagaatgtcattggtgttttgaaggggattacattggacctgaagattgctttgggttgtttgctgttggcaaataaatggaaatgctactgattt

SEQ ID NO: 344230 - DNA, 459 bp, Homo sapiens
cttcctgatttgaacctcaagaggccaacctgcatggactgcttccacagatcccttgtcctctgacttacagttgaattcaccaaatagaagacattggaaatgagacccgagggttggaggaggaggaagcctgcaatgtgaacacgatggctggagctccggcagccattctggaccaggaggtagccttgaagatggaagccacatgttgggatggtgaatccaaaagatgaggagcctgtatcccctgtgacaccagaactgccataccagccctgggttcctccatctatactgccttcatatggtaaagaaatattcttggatcttgttaggtgtctgttgcagccaaacacaatcccaactgatattcactgtaaatgattccatggctccctgtagtacttctacaaagcatctatcacaattgtaattaataaaataattatgcaatta

SEQ ID NO: 344231 - DNA, 404 bp, Homo sapiens
  misc_feature (149)..(149): n is a, c, g, or t
ggtgaaatgctcattgaaattatatttttaaatagttaaatcatgataaccacattgactacttagtaacacacacagtgttagtgtgttagcctccattgtctcctgtctcatcttcacagagaccacatgaggtaggtactactccncattaggtgagaaactaaggtttagagaagctgagtaactttaccaaggtctgtggcgtggccaacaggcaagcagggcctcaaacctgggcctagtctactccaaactacatgctgccattcactatactctatactaactggtgatcttggccttaaatctgttttagcagtttaattcttgtttatataaatgatcttaaacactttatggggtttttttgggttttgtttttgtttttgtttttgagactg

SEQ ID NO: 344232 - DNA, 224 bp, Homo sapiens
gccaaagcagcaggaggattgcttgaggccaggagttcaagatcagcctgggcaacatagtgagaccccaacacttaaaaaaaaatagctgggcatgatgtcatgtgtctgagtcctagctattcgggacgctgaggcagaaggacgaggagtctgaggccgcactgagccatgattgtgccactgcacttcagcctgggcaacagagcaagaccctgtctctt

SEQ ID NO: 344233 - DNA, 836 bp, Homo sapiens
aaaatgaaaggcaaaaagcaataaaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaaattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataa

SEQ ID NO: 344234 - DNA, 891 bp, Homo sapiens
aaaatgaaaggcaaaaagcaataaaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaaattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataa

SEQ ID NO: 344235 - DNA, 574 bp, Homo sapiens
tgagatcagaataacatatccagccttgagaagacaagggggtggagggagtgttccagggaaaggagacaccttatacaaaggctggaacaaattgaatgggttcagaaaacaaaaggaaggcccagagtgactggagcgtggcatttagggatgaaggtcaagtcagaaaagtatgtaagagtctggtcaagtaacagtctcgtaggccaaggtaaggaatttgggttttattttactgcagtgagagatataggagatttcacacagaggcgtgaaatggtctgatataggtttctaagaaccattctgacggccattagaaagtgcaagtttgggaatatggcgatcactgagaaagctatgggaccgtgcatggtagatcatgcctgtaatctcagcacttcggaaggccaaggcaggaggattgcttgaggccaggagttcaagaccagcctgggcaacacagtgagacctcatcgctacaaaaaataaaaacataagccaagtgtggtggcatgtgcctgtagtcccagctactcaggaggttaaggcaggaggattgcttgagccc

SEQ ID NO: 344236 - DNA, 635 bp, Homo sapiens
ccaacatggtgaaactgtctctactaaaaatacaaagattagctgggcatcgtggcatgtgcctgtagtccctgctactctggaggttgaggcacaagaattgtttgaacccggtagtcggaggttgcagtgagacgagatcacgctgctgcactccagctctggtgacagagcaagaccctctctcaaaataaataaataaattggacttttccaattaatattctgttctgtttaactgatctctcatgatttttgccttttaactctgtgcaatacattctgagtaatttcctcatatctatcttccagctgattgttttttcatatctgattaatctgctgttcaagccatcagacaattttaattatgacttttaatctagaaatttgattatttaaaaaatctgccctactttcctccttagagtatctgttatattctgttttttgatggtctagcttatgattatgattattctgaaaatactatctttcagatagttcttttattgggagtttttgaagggagcgtctagtccctcagtttgctgtaatttctgactcttgcacatggtgaagtttttccttgtacatttgtagtttgagattgaaagctcattttcagcagagct

SEQ ID NO: 344237 - DNA, 168 bp, Homo sapiens
cttaaactgtacagagaagtacccttacatctgttggtggacaggttgtttacaatcttggctattgtgaatactgctgcagtagacatgagagtgcagatatctctttgatattgatttcctttcttttggatgtatacccagcagtgggattgctagatcatatgg

SEQ ID NO: 344238 - DNA, 408 bp, Homo sapiens
tatcagcattttggtcacgaccattaaccaatctctgagatgttccaaactttcctttatcttcctgttttcttttgagccctccaaactcttccagcctctgctattacccaattccaaagttgtgtccacgttttcaggtatctttatagcagtgtcccactccttggtaccaattttctgtattaggccattcttgcactgccataaaaaaatacctgagactgggtgatttataaagagatttatggttcatggttctcaggctgtacaagcatggtgccaacatcacttgggttctggggagatataattcacatactatacaattcaccgatcaaaatgtatagttcaatcacttttagggtattcacggagttgtgcatccatcacggcaatcagctttag

SEQ ID NO: 344239 - DNA, 348 bp, Homo sapiens
gatcttcaagttgagaaacatcagaggaaagcaagatttctctcgtgctaagaaaaaggaaaattgggccaggcaaggtggctcacacctgtaatcccagcattttgggaggcttgaggcgggcagatcacgaggtcaggagatcaagaccatcctggctaacacggtgaaaccccacctctattaaaaatacaaaaaattagctgggcatggtggcacgtgcctgtagtcccagctatttgagaggctgaggtaggagaatcacttgaacctgggaggcagaggttgcagtgagccaggatcgtgccactgcacttcagcctgggtgacagaatgagactctgtctc

SEQ ID NO: 344240 - DNA, 411 bp, Homo sapiens
tgggttcaccttcctcactattgctttgctgagctgggtgggtttgggaaacccatttccacttaaggaggctcagtttgcctgtctgtgaaatgggcaggatgaggtgacccacatcccttggctactagaggttttggtttgtccccatgatcttgggagaggtggatcatcagtgcctgtaaaacaggacatggtagttaaaaaaagaaaaaaaccctgattgggttttgcagtcagaatcttccctggtgagtctctgtcacccaggttggggtgcagtggtgagatcatggctcactgcagcctcaaactcccagactcaagggatcttcctgcctcagcctcccaagtagctgaaactgcaggcatgttccaccgcacccagctaatttttaaactttttgtaga

SEQ ID NO: 344241 - DNA, 572 bp, Homo sapiens
gttgaatatccaacatcccccacactgccccagtgtctctgctcccttactgagccttactattattcttcatagccctatcactacctagtctagtattcactgaactgtgtcatccactagaatatgagcataatgagagcagagactacacctgtcggttcagtattctatcctcagcacatagaatggtacctggcacatagcagatgctaaaataaaatttaaatgaataaattaattcaatcaacaccttcaaggtgttattattacctacaactattgtttacaagaggtatgcaccgtggaagatcctggagacacaacaatgaataaagccaagccagttcctgcccccgtggagcttgtagtcaagacattgaacaagtgatcagaaagatgttgactgctgcagcagagggttgcaagctgctcatgagtatataacaagtagccctaaccaaagcattctctcccttggtttaatgtccacccattgaggtgactgctaaatactaatccatgactctatcccttggcattcaaactcacacatccacttacctgcctct

SEQ ID NO: 344242 - DNA, 560 bp, Homo sapiens
aataatagtgaattatctaagggagaaattatttaacactcattagatggttactcttggatatcaattgtgtcagccagaaaatagtcaaaaaattaaaacttaaagtccctgtagaagtccaggtatcctagttattgattgaaaggatcactatatgctttattttctagatttatagttgacaaactcgatgttttattgcaaaaattttaaagtttaccttggcatctgttcaacccccaaattgtgcttcacaaaacatggaatagaacaccacatcctagaagattttggtagcaggagtcaccagatgtctttgcctatcataaaacaatcatgcgattttgtaaaatgcttaatttttaagcaacacatcatcctgatgggtttccaaagatcattcagaacaaaatagccacccaaataactaaatgacttaaactgttaagtagagttgttcagcattatccatctgagtcctgaggaaagtgtgcctaaagggatgattttattttttctataattgatacttaaccattccttctgttagcaattag

SEQ ID NO: 344243 - DNA, 413 bp, Homo sapiens
agcatgagtccacaggagctggtacagggcctgggcccacaagggctggcctggagcttggggctgcagggacttacctggcaactagagtggctttggatcctggttctactgaaggctttgtctttggaaactggtctgaaggctggatcagtgggttctggactagatactagatcctcactctggcttggaccgtggagccacagggccagtctggatccatgggtataggtctgtgctctggagccacagtgactggattcatgggtagaagtctccgttttcgggtcaagaggctggatccacgggtgtgggtctttgttcagggcccacagtgactggcctggagactgggtccactggggccaggctaatgccagtatctctactggaacttatctggatcccag

SEQ ID NO: 344244 - DNA, 258 bp, Homo sapiens
aggagttgttgcagatccctggctaattaatcacttggaggcgggtgcaggggggctgtccaatggtggcgcaggaagaagggggcgtgggcgctggcagaccattcacatggtttgggtttcgcccagacctcgggttcatgccgtcacatcttgtccatctagagaaaggcacgcagagtccaggaatactcaaacccctttgtgaaaactcagaggaatttggtcagtaaggaactgattaatcaaaaaaaaaaa

SEQ ID NO: 344245 - DNA, 305 bp, Homo sapiens
tatttagagatttattataaaaatttgtgatagtttctagaaggtatcagcagccatccattcccttgccctattctggcctccaccacttttcctcagaagctagtttacctaattatcaaccactttttgtgtaaagcaatgcagatagagaacaatagaatggagaactcatccaggttagtgacattctcacagggagtgtgttggttctaagaccaggttctaggatatggttcttagcttcacaggacctgaaagctgattcttcattattttaaagtttattagcctttccaggatag

SEQ ID NO: 344246 - DNA, 411 bp, Homo sapiens
aacaaaatgagattaaaatattccctcagttttaaaggctagctaatttattcctctattattgatttactttcttatgtgtcctgataataacaagatctatcatttcttgagcaacagcttagttcctaacacacagccaatttttctatatgttctttttacgccccacttattggatattaaaacaaggagggttttttttttttttttttttttttttttttttttttgagacggagtcccactctgtctcccagactggagtgcagtggcactatcttggtttcctgcaagctctgcctcctgggttcacgccattctcctgcctcagcctcccgagtagctgggactacaggctcccgccaccacacccggctattttttgtatttttagtagagatggggttt

SEQ ID NO: 344247 - DNA, 611 bp, Homo sapiens
caataaaccattagaaaaaacaaatgtacacacacattaagtgacacaacttttatttttatttatttattttttaatggatggtgatttcaatgggtggcgatttcaatggggatttttcctcgtgacaagatttgttcttactcttgttgaattagaaaagttagctccaatattatgataaattggatatataaatgtcagtgctaatagcttagtattttagtcttccacaaattgatgcctgtggtatctggacattccttgcctgttcttgtaaataaggagatagtgatgtttaaggaatagcactctggccagaagagcaaaaaaaacaaaacaaagcaaaacaaaaagaccaggtgctgtggctcacgcccgtaattctagcactttgggaggccgaggtgggtggatcatttgaggtcaggaattcaagaccaacctggccaacgtagtgaaaccccatctctactaaaaatacaaaaaattagccgggcgtggtggcaggcgcctgtaatcccagctacttgggaggctgaggcaggagaattgcttgaacccaggaggcagaggttgcagtgagccgagatcatgccattgcactccag

SEQ ID NO: 344248 - DNA, 362 bp, Homo sapiens
gctgggtcctatggtaagcatatgtttaggttttttaaggatgtgcaaaaaaatattttccagaatagccgtaccatttgacattctcaccagcaacgtctaagagatctaacttctccacagctttaccagtcttaagttcactactttttacattaattattctaataagtaaggatgttgaatatcttttcatgtgcttagttgccattggtatatccccttcagtgaaatgttattttgggtctttctctgattttctaattgaacttttttgatatatttaatacctcccaaatttacatttttggaaagtgtttgtttgcttgttggtttgtttgttttgagacaggatctcactc

SEQ ID NO: 344249 - DNA, 1889 bp, Homo sapiens
gaggtcagaagataaccagaaaaataccattacaagcaaagaaaattacagaccaatatccatcataaatgtgcaaaaattataaactaaattttagccaaatttaatgatttatacacatacatgcttacacacatggacacacacacgtatcctttacatgcaggtataaagaataatattaatacataatgaccaagtgtgtatcccaggttggttaacattcagaaattggtcaatctaattcactacattaataaactgaaaaaaatcacatgattatctcaatagatacagaagaagcacttaacaaagtccattatttattcctagtaaaaattatcagtaaaataagaacagttgagattttcctcaaactgataagaggaatccatgaaaacctacagctgtcatacttaatggtgaaacagtgaatgctttgtgcctacgatcaggtacaaatcaaagatgtcttcattcatgtcttctttcaccattgtacttgaaaaagaataaaagacatccagagtggaaaggaagaagtgcaactatcttaattcatggacaacatgaccattgtagaaaatctgatagaatctacaaaaaaagctattagaactagtaaacatcaaaaaatttaaaatacatagggataaatctgttataaagatgtgaaagacctgtgtgctaaacactgcaaagcattccagagagaaattaaagaggacctaaataaatggagaaacacttcttgttcatggtttggaagattcactattccagatatcagttctccctaaattaatctatacaatcctaatcaaaatctcagccagcttttcaaaaaatagaaactgacaaaaaccgattacaaaatacatttggaaatacaaaggatctagaactactttgaaaaagcagcatctttatttataatagccccaaactggaagcaacctaaatggaaaaaaaaaaaaaaacaacctgtgattagatcatgtaacgaatactattcagcataaaaggaacaaaaatattatgcaacaatgtggatgaattgcaaatacattatgctaaatgaaagaagtaatctcaaagagcacatactatatgcttccatttatatggcattctgaaaaaggcaaatctttaacagtggagaatgtatcagtagttgccagggtttaggaactggggaaggaactgataaaggagttacctgagagaatttttaggggtgttggaacaggtctaaatttttgttatggtggttacaaagttctatacctttttcaaaagtgatataattcactaggcatggtggcacgttccggtagtcccagctactcggggggctgaggcaggaggatcatctgaacccaggggttgaggctgcagtgagcccgtgatcacaccactgcactccagccaggaaaacagaaagagaccctggctcaaaaaaaaaaaaaaattatgattaaagacagatgttctgcattgtataaggtgaggttatcttatgtctctctctgctactccagcttattctgtagtatctgtattttgttttgcatattgaccttgtgttaagggttctttagaagaaaaggtttaggctgcgtgtggtgtctcatgtctacaaccgctaaggtgggaggattgcttgaggccaggagtttgagaccagcttggggaacatagtgagactccacctctacaaaaaaaatttttttaattagctgggcatggtggtgcatgcctgtagcccttcctacttggaaggctgaggtaggaggatcgcttgaacccaggagtttgaggctgcagtgagctatgataatgccagtgcactccagcctgggcaacgtagcaagatcttgtctctctta

SEQ ID NO: 344250 - DNA, 872 bp, Homo sapiens
  misc_feature (822)..(822): n is a, c, g, or t
  misc_feature (868)..(868): n is a, c, g, or t
gaggtcagaagataaccagaaaaataccattacaagcaaagaaaattacagaccaatatccatcataaatgtgcaaaaattataaactaaattttagccaaatttaatgatttatacacatacatgcttacacacatggacacacacacgtatcctttacatgcaggtataaagaataatattaatacataatgaccaagtgtgtatcccaggttggttaacattcagaaattggtcaatctaattcactacattaataaactgaaaaaaatcacatgattatctcaatagatacagaagaagcacttaacaaagtccattatttattcctagtaaaaattatcagtaaaataagaacagttgagattttcctcaaactgataagaggaatccatgaaaacctacagctgtcatacttaatggtgaaacagtgaatgctttgtgcctacgatcaggtacaaatcaaagatgtcttcattcatgtcttctttcaccattgtacttgaaaaagaataaaagacatccagagtggaaaggaagaagtgcaactatcttaattcatggacaacatgaccattgtagaaaatctgatagaatctacaaaaaaagctattagaactagtaaacatcaaaaaatttaaaatacatagggataaatctgttataaagatgtgaaagacctgtgtgctaaacactgcaaagcattccagagagaaattaaagaggacctaaataaatggagaaacacttcttgttcatggtttggaagattcactattccagatatcagttctcctaattatcttcatctataattagcanttcaaaatgactgcaaccgtcaatcttgatcagactgctcttgaangttt

SEQ ID NO: 344251 - DNA, 422 bp, Homo sapiens
aaagttttctactcaactgcagaaaagggattgaatagagactttgtttcatattcataccccttcaaattttgaattacatggattaccccttcaagaaatgaattttttaaagtactaaaataaaagcaagggttagaggtggaggtatcaagtactccctatgatttcgcagctttcagaagatcggtcctcacattctatgggcactaaaatggttgggcctcaagacacctccatgtggggtatattctttctaaccacagatttctatcttcattgacaagataaacactgcaactataagttttgcctatagcttttggttttaacttcttttgaggttctccttgctaacgatctaggcactaacccctaacttccatgtctttttaaaatgtgccttgtggctttcagtggca

SEQ ID NO: 344252 - DNA, 690 bp, Homo sapiens
gtttgtatatatgtctagttgcaatttcttttccatgcagtactccagataccacacaaaataagattactagtgggtactcattgttgaaccacagagtgcattgtaaaccagatacacattttctcccatgccattccttctgcaggtttttctagattccttggtggatacttgtatcttgtgtttattttcctctcctgcctcagacgtgatgcctggtgctgactttttaattttttttttcttaccagaaagtactgagctcaactgaaacagtgattttaaataagcagtgttcatggttttgttggttagtgtgtctttcattttctggcccattattgaactcctttcctagttttactataaactttaagttcgatgggagaaggatcaaagaagacaaaaacacaacgcattccagttaattcaaacaatatttcgtgagcacatcatgaacttagtcaatgtgatgatcatcaaaaacacatcttcaaataatgcgtaactagtcctttgccctgccctcaaggcgctaaagatctgacaagatgctgtcttgctggccgcaggaatctggagttcagaacggaggtctagacacagcgggaggtgacatgaaaaaggtaaaagtagatattataaagagagaataggaagataaaaagccagagaaacctgggagcc

SEQ ID NO: 344253 - DNA, 412 bp, Homo sapiens
aacccatttatgctggaggtggcaaatttttttgtgtgtgaaaaatcagaccatggtgatgaccctgagcagtagggtcatctagcagtaggaagtataaataactcccacaagcttagtgctccaataatggaacactaggcataaatgggttagcttctctctttccaacaggcccctgaactttgacacacactcagcctgagccaacaaataattcctccttatgcccctcctaaacacaggctgacctcagggtgaaacattctctgatctaggatctaattttggcacctttcatcctgtcctccccttcccacattctttctagttttgtgtgttcctctttaaataaagcccttttctgcctaacatttcagatgactgcagatatagttggtatttttcccgt

SEQ ID NO: 344254 - DNA, 547 bp, Homo sapiens
cttctgagtcacactccactttcttcaccaactcctaaaatgcaaactgctctttacctactgagttattctgcttatatttctaatttttctgattgtattatattctgattatattttggttctggttatattttcctactgtatttatatttactccactatgacattccaaataaagtggactattttaatgagtctatatgtgtgaaatgtgtgcctaaacattttgcacaaatggtggtatccctgccggcgaggaagcatgataggaatcaggctatttttgagtcagaggatctggatccggggccgaggctggcaccggctcctcctctgagctggcacctcctgggggaagcagctgagctgatgagcgaggttgcaaggtggggcgggagcttctgttaaagtccagctctgctaactctgccgcccgcccactgggtgaaatgctcctgaagcagctgtgcatctttcccgtccccgaggctcggtcttagaaagaggggcctgactcagactgaaatgcgatcacccagcactg

SEQ ID NO: 344255 - DNA, 659 bp, Homo sapiens
tgtttaattcacaaaaatgttttaatagccaactgtgaggggagggagaccagaagttcattagtgaggcacagtaaatgtgatgctgaggtatggcacctgtactgctaaaggagagcactggcatggataaaacatttggcatttcctaaaatcacctcctggcctgtctttcaagcaagtgaaaaggaagaagttgtggattgatttgggaagtacatttggaaaatgacctaatgtgataagctggaaccaatagggttaaaaaccctggtgaggtatacagccttgattctaaaagtggaaagtttgagtgaaggctagacccttggaaattgtaggggaggtagtgtaaaatgaagaatacatggccaggcgcggtggctcacgcctgtaatcccagcactttgggaggccaaggcaggcagatcacctgaggtcaggagttcgagaccagcctgaccaacatggagaaaccctgtctctactaaaaatacaaaattagccgggcatggtggcacatgcctgtaatcccagctactcgggaggctgaggcaggagactcgcttagacccaggaggcggaggttgtggtgcgctgagatcacaccattgcattccagcctgggcaacaagcgtgaagctccatctcaaaaaaac

SEQ ID NO: 344256 - DNA, 1831 bp, Homo sapiens
cagcctgtggccgctcccggctcggagtgtgatctaagcaggtcgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttg

SEQ ID NO: 344257 - DNA, 916 bp, Homo sapiens
cagcctgtggccgctcccggctcggagtgtgatctaagcaggtcgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacgtaagtctgcatctgcctttagtaacgtcataatggtgcactagaagtgatcttgctatttagtgcttctcatattttgtagcaccaggtgatgccacacaactgatatgataactgtagatttcc

SEQ ID NO: 344258 - DNA, 2867 bp, Homo sapiens
cagcctgtggccgctcccggctcggagtgtgatctaagcaggtcgcgtaccttcctcaggtgactccggccacagcccattgtccgcggccaccggcggagtttagccgcagacctcgaagcggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagccctctactttcttcttgccacctttttgtggcaatattaaagtgaactgctaatagtgtaagtacgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttg

SEQ ID NO: 344259 - DNA, 2864 bp, Homo sapiens
cagcctgtggccgctcccggctcggagtgtgatctaagcaggtcgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagccctctactttcttcttgccacctttttgtggcaatattaaagtgaactgctaatagtgtaagtacgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttg

SEQ ID NO: 344260 - DNA, 2864 bp, Homo sapiens
cagcctgtggccgctcccggctcggagtgtgatctaagcaggtcgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaaagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagccctctactttcttcttgccacctttttgtggcaatattaaagtgaactgctaatagtgtaagtacgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttg

SEQ ID NO: 344261 - DNA, 1974 bp, Homo sapiens
cagcctgtggccgctcccggctcggagtgtgatctaagcaggtcgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttg

SEQ ID NO: 344262 - DNA, 418 bp, Homo sapiens
tctcaaactgagctccttatcacatccacagttcaggagcgccttacaaaacaaattgctgtagcaatcacggaagccttgcggcctgctggagtcggggtagtggttgaagcaacgtaagtctgcatctgcctttagtaacgtcataatggtgcactagaagtgatcttgctatttagtgcttctcatattttgtagcaccaggtgatgccacacaactgatatgataactgtagatttccatccctgagcctaaagctcttttaccactttcatttactgttactgatataggaacagaatatgggagaagtattttttgagggtaggatggggcttgtggaggcatagggagttaaaagcacaggtgtagagatttgcataatcaatagccttttttttttttgagatggagcct

SEQ ID NO: 344263 - DNA, 601 bp, Homo sapiens
tttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttgttcttgtgaaagttgtttctttttcaaccaccactataaatatttaaataacttg

SEQ ID NO: 344264 - DNA, 2918 bp, Homo sapiens
cagcctgtggccgctcccggctcggagtgtgatctaagcaggtcgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagccctctactttcttcttgccacctttttgtggcaatattaaagtgaactgctaatagtgtaagtacgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttg

SEQ ID NO: 344265 - DNA, 1919 bp, Homo sapiens
cagcctgtggccgctcccggctcggagtgtgatctaagcaggtcgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacgaagtcaaataaatataataaagggttgagccctctactttcttcttgccacctttttgtggcaatattaaagtgaactgctaatagtaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttg

SEQ ID NO: 344266 - DNA, 3121 bp, Homo sapiens
  misc_feature (2946)..(2946): n is a, c, g, or t
cagcctgtggccgctcccggctcggagtgtgatctaagcaggtcgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagccctctactttcttcttgccacctttttgtggcaatattaaagtgaactgctaatagtgtaagtacgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttgaaaaaaaaaaaatgactactttgagacnagcagtcagtgctgcaagcccaacgttctgggggtgaccaagacacgactgcccgtctgtgctggccctattaaggactgggttcggagattctttactgacctggacctgaaaaactcaggggttcacaaacttaaatgcctagcaaccttaccgttttcagaggggaggagca

SEQ ID NO: 344267 - DNA, 2864 bp, Homo sapiens
cagcctgtggccgctcccggctcggagtgtgatctaagcaggtcgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagccctctactttcttcttgccacctttttgtggcaatattaaagtgaactgctaatagtgtaagtacgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttg

SEQ ID NO: 344268 - DNA, 1919 bp, Homo sapiens
cagcctgtggccgctcccggctcggagtgtgatctaagcaggtcgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagccctctactttcttcttgccacctttttgtggcaatattaaagtgaactgctaatagtgtaagtacgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaaatgtttcttcttcttcttttttttaatcttataagattaa

SEQ ID NO: 344269 - DNA, 441 bp, Homo sapiens
tgctctatcttggatggggggagggcaaaatgagctgggcaggcttgtgctccggttccctaatggtgacagcagcaaccagccatgatgggcatgggtggacaatccccaggcctcaggtggagtgttctgcttggtaaagagacagtagcagctgcactgaggacttgcctgggtggtcatagtctgggccaatgggtgagaaacatgcaacccccactcataccccagtcttagtggggctggcccctccagcagtgaaagcctatgcctagcttacaccttcttggtcgtaagagcaagtcccaaaggcaactcacaccctgttcatatcctaatccccatcctggggttgcccacttcctggcagcagcagctgcagtgcacaccttgctcacttcctacgccaggtgagaaggcactcccagctcactcccaagt

SEQ ID NO: 344270 - DNA, 310 bp, Homo sapiens
aaatagctatcaacacacatctttacccagttacttggcctttataccttgtactatggatcaactactcatgctcctaagtccattatttctgtttatattgtacattccatttccacttgcctactaataggcattgcctaagaaattctcccctctcttttctacattgtattttcactactaagtattaccattaacatgttaaaaaaattcttttaaggaaaaaaaaaacccaaatattttggctctgttatttcccctttattttattttatttttattttttttgagatggagtctcactctg

SEQ ID NO: 344271 - DNA, 229 bp, Homo sapiens
tcattctcttcagctctaaaagtggtgactaatgcctgccctgcagtgatgtggggagcctaggagctaggttcttaggcagcgccccgcacttcaacatgactgaataatggccttctcttggtctcaggcccaccattctcgtgggtgaaactggaggttggctgactgggcgaggccactgcttaggaccttcctcctgtaaaacagggggagtggcctcagctct

SEQ ID NO: 344272 - DNA, 468 bp, Homo sapiens
aatgacttcctacaacctcttcctctgaaatctaagggaaaatgaaagaatttaacacagagataaagagaatttggaacctgagggcgaatgtgggaactgcctcatataaatcagcttttatctcatctgagatgaaagatgtgtaatcatttattgaggatgatgatggggcagcttgaagatagagacccagatagcaaagggtgctgggaaaaacattacaaggaaggtctaagaatatctgcaaaggagagagcttttctgggaatgtcagtcttaaccaaaggttactgaaagatgcttctataaaggaggatcaccttcctacccacaaagtgttgtgggaagtcagggatcccaaacagagggaccggctgaagccatggcagaagaacgtggattgtgaagatttcatggacatttattagttccccaagttaatacttgtataatttcttatgcctg

SEQ ID NO: 344273 - DNA, 532 bp, Homo sapiens
tgtgttgcccaggctggtctcgaacttctgagctcaagcaatcctcccacctcagcctcctaaacatagtaggttcttaaatgttttgatgggtgaatgaattaattgatagttgacaggactttctaactggatagcagatggaactgggaagtagaggagacagattactgaaaattggaagaacgcaaatatggaatcctgttcagcgggtgtttgctgagcccttcttgtgcaaaaggctgaagcgggaagtgcaaaataggccccagctgctggtgtactccagggaggggtccagagcccagaatctgcccatatacaccagttctaggtcttagtctcaccaacctaagatgtcagtttcctttctgctcacccacctgtctgaatttgagaagtagatacttctttgttttgttttgagtattactgtccacaggcatagaatccatgtgactgtgactttaaggctgtatattattccattatattgatgtattatcatttaataaaaccattccctggcaaa

SEQ ID NO: 344274 - DNA, 390 bp, Homo sapiens
ccgctgcacctggcctcattcctgtgttttttatttaaacaggtacaaaggaatgtagttcacaccttgtcccaaacctgggtactgcagtacccaagtgcattgcaaaacaccctgatggacagtgacatcttgagctttactcagtactctttgcaaatttttgacaagaaaagtgcaagttactaaggtggtaagaagtggagggatggtcaacatacaggtgtgtgtcgagggtgaggaggtaaaggtcccacaattgtcaggcagaggatgtctgggcattgcctttcttatactcccttatcagcccagaagctggaagactcctgcttccctttgagtggtctctgtcacagtcacggcaccctcccctgtgactcccagcca

SEQ ID NO: 344275 - DNA, 396 bp, Homo sapiens
tgctgcactccagcctgggcgacagagtgagacaccgtctcctccaccacccccaaaaaaacttattaagaaattaaatactaaaatattaaataaaaatatggatatatacagctgggcgtggtggctcacgcctgtaatcccagcactttgggaggccgaagccggcagatcacctgaggtcaggagtttgagaccagcctggtcaacatggcaaaaccctgtctgtactagaaatacaaaaattagtcaggcgtggtggcaggcgcctgtaatcccagctacttgagggaagctgaagcatgagaatggcttgaacccgggaggtggaggttgtactgagctgagattgcgccactacactccagcctgggcaacacggtgaaactccatttc

SEQ ID NO: 344276 - DNA, 218 bp, Homo sapiens
tgagggcatgtctggctggcacatcacagtatctactctaccagctcacagttattaccgtggtactaaagtcagggtctctcagttacccttagtggtggcaagttaagcttatatgttaggaaattgggctactaggcagtagtcatgaagtcatgaggcttcaagatcaggcagatagccagttttttgttgtttttttgagatggggtctcact

SEQ ID NO: 344277 - DNA, 628 bp, Homo sapiens
tttttttttggagacagggtcttgctctgtcacccaggcttgagtgcagtggcatgatctcggctcactgcaacctgcgcctcccgggttcaagcgattctcctgcctcagcctccctagtagctgggactacaggcatgtaccaccatgcccaactaatttttgtatttttaatagagacggggttttgccatgttggtcaggctggtcttgaactcctgacctcaggtgatctgcccgcctcggcctcccaaagtgctggcattacaaaatgagccactgtgcctggccctcttttcacagtttttgacttaaaatctgttttatctgatacaggtatagctagtcttgcttactttgtttctggttgagtgaaatatcttcttctgttcctttacttttagtctatatatgtctttagaggtaaaatgattttcttgtaagcagcatataggtggatgtgtcatgtgtttgggaggccgagccgggagttttgcttgagcaggagtgcaagaccaacctaggcaacatagtgagatcccatttctacaaataaatgaatacataagtaatttaaaagctacagagggagaagagattaaaataggcccattcagccaggttgtgt

SEQ ID NO: 344278 - DNA, 261 bp, Homo sapiens
gattgcctcaactctaaggattgaactgatattgaagtttcattttaattaattacaaagtgcatcgtaaagtttcaaacagtaaagttttactagaatcaccagagttgaggtttaattaaaagacttttgaatctgagctttgattcaaatctctataggtatgttgactactgactatagttaagtaaatagaagagtcatattgtccacccacaattttttttttcttttcttttcttttgagacagggcctcactc

SEQ ID NO: 344279 - DNA, 328 bp, Homo sapiens
gagctgggccagtgtcggggtacccagcgggataaagggttcgggacctgggctccaaggagggggctgggaaggggtgttcagggaggactgagtgatggcttggaggcggctggaccaggaacacctcatgggagtttgcgaatggggaggggactctggagatggctgtgccaggcctgacttcattccttgcattcctcagcaggccccagactcctgatggtcctaagtgggggaaggtgagccagagagggccttctgggtactgccctccccccactccatcagtctgtctcagtctctctttacaccctcccccatccag

SEQ ID NO: 344280 - DNA, 389 bp, Homo sapiens
ctggttgtagtatatagagatacagattatataatcatagagtatcagaaggcttttaggaaactcagtgtaaatgttgcctgaaataaccccagtgtctcagaagcactatgaaatggagacaaactacagatagctgatatttcatgatctctgcaagcaacaactcccaattcaggtctaattctcagcattctgggcagagaacaccatgagatctttctcctgcatgtgttctaaaccctaattctattaccctcaataggtgttaagttaaaaaaaaagctgtgaaatatttcaaatttaagtataattgattaatgagaacaccataaaggtgctgtcaaataataataaatattaataaaaactctggccaaagacactct

SEQ ID NO: 344281 - DNA, 503 bp, Homo sapiens
tcaggttgttgcatccatcatatgaggctaaaactaatttctcagtatagaaattaaatgatgaaataaatgtaaaatatttacctcagtgcttgacacaaaaatcaggactcatatcatttctttcatttctggcagtacaaagataaactggtacacttctctttcctcaggaaactcagtgtaaatgttgcctgaaataaccccagtgtctcagaagcactatgaaatggagacaaactacagatagctgatatttcatgatctctgcaagcaacaactcccaattcaggtctaattctcagcattctgggcagagaacaccatgagatctttctcctgcatgtgttctaaaccctaattctattaccctcaataggtgttaagttaaaaaaaaagctgtgaaatatttcaaatttaagtataattgattaatgagaacaccataaaggtgctgtcaaataataataaatattaataaaaactctggccaaagacactct

SEQ ID NO: 344282 - DNA, 611 bp, Homo sapiens
cgcgcccggcccagtgtggcattgtttttaacagagtgtctttaaaaataaaggctttttaaaatataaatatagcatagaaactaaaagcagtatcaaatacctagaaagatgccaagtaactggaaaagcttacctgattttagaattatttttaggtggaaaggatgaaggaaagataatcttttaatgtataagttaagcttggtgcagtgacaaatgtgtatagtctcagctactctggacgtgggaggattgcttgagcctaagaatttgaggctgtaatcatacctgtgaatagcaactgcattccatcctgggcaacataccaagaccccatctctaaaaataaataaataaatcagtgtttaggttaaaaatacagtctacagtagtaaagtagccaaaatattctaaacctccttacaacaatacaaacagcatatacagtattttaaaacatccctccttagaagagatttatggatccttttggagaagatcaaaaatattgcccattaaattgtgttggaagttgtttttttctttagttatggaaagaaaaggaaaggaagggttcattgaagttctttttcagtaacttgctttgt

SEQ ID NO: 344283 - DNA, 284 bp, Homo sapiens
atttacagaggtctcccaatgcagtttctggagtctagactgtaaattcctgaagaacaggactgtcttcccagcacttagctctgtgaatgacacatcatagggggcccacaatcagtcattaaactggatggttctcaagtgcctatctgaggtcaggacagatttacagacaactctcctccagtcaagggcaaaagtgtacaatgatgcttccctgcaccctgagagggcagaaaagagacgtgggacatctgcccaacctcagtaaggcaggattcctc

SEQ ID NO: 344284 - DNA, 410 bp, Homo sapiens
aaatggggagttggggactaggggacctgattcttgttttatgttcaaaggagagtgaagcattctctccattaagaaataacctccttaagtgtattctcactttggagttttgccactcattcattcacctgacgatgattaaagatataccacattctgggcatgtactaggtgctagagtaacaaatcttgggccttgtcgtgtagagcagaaaggtatgggctcaactagctatgttacaacttctagagaaccaaaatagagcaaacaaagagtggtgtgggattataggaggagggagaaattccttctagggagaggagaatgatacacagagaaaagtgaggttagggaagacttttcacataggggaagtttgagtaggacttggaagggggagtagctg

SEQ ID NO: 344285 - DNA, 692 bp, Homo sapiens
catgcatggctagcttttgtatttttagaatagacagggtttcaccatgttgggcaggctggtctcaaactcctgacctcaggtgatctgcccaccttggcctcccaaagtgcagggtttacaggcgtgagccactgtacccgatcctcaaacagatatttctacaccaatgttcatagcagcaatattcacaatagccaaaaggtgaaatcaacccaactgctcatcaatagatgaatggacaaacaaaatatggtatgcatacatacaatggaatattattcaaccataaaaaggaatacaattctgacacatactacaacatggatgaaccttaatgacattatgctaggccagtcacaaaatgacaaatattgaatgattccatatatgtgaggtcctttgaatagtgagattcgtaacaaacagaaagtggaatgctggctgcaagggatgagggggtggaagatgaagtattatggtctaatgggtacagagtttcagtttgggacgatgaaaaagttctgacagatggcagtgatggttgcacaaaaatgtgaacatacctgaactgatcacttaaaaatgattaaaatggtaagctttatgttacatatgtatgatcacaattaaaaaaagacaactatttagacaaaaataatgaacataaatcatggattttcaacatatag

SEQ ID NO: 344286 - DNA, 275 bp, Homo sapiens
ttaaaggaaacattgatcctttaaaagatttggggaaggaaaaacttttttttcaaaacactctgccattgaggtgggagactggttcaggtttgaatggtacagtgctgtttggtgctttcattagtgtctctcaggatttttccagtctgaaaactccaaggcgagagatgtcatcccgagtggtagacagtgatccttacaagatgccagggaggccaacagtgcataacgtatagggatggacgggacaaaagaggagggtagaagaagag

SEQ ID NO: 344287 - DNA, 347 bp, Homo sapiens
agtttattcacaggatgagggagcaaggcggaggctggagggttttaagccagtgatgaaatgctcagatctctctggcagaggggagctttgagggtgaggcaaaaggacagtgagagatgaaggtgccaggacctaagtcgatgggaactgggacaaaggcctggggcagaccaaagacaaatttcaaacagaaaaaaaccctgacaactgtgtgtggcaaggagggtgagggacgggaaggttgactccagctctgtgattcccccttgcacagaggaaatgatcgcaggggaggatccggcgtgggcaggtggagccggaggtgcctggatatgtgcagtcgg

SEQ ID NO: 344288 - DNA, 436 bp, Homo sapiens
  misc_feature (350)..(350): n is a, c, g, or t
  misc_feature (405)..(405): n is a, c, g, or t
gactctccttcagcaactccagaagcttcagactttggtgatgggcaaggtttctcgaacctgcaagttagctggcacgcagactggcacctgcctcatggtgagcttcccagcagggtagcacagtgaccgcccctgcctggcccctgtctcccctctccctccacttgccaaggccaagtgctgtgctgtaggagaaaccacatggaggaactccactctgaggctgttcctcggtgaggcactctggtgatgtgactggtgggtgcagtccactggcctgaagaggagagtctgtgtccctgggtataaagctgtgctgtccagaggctgaagtccacagcccctcngtgttctctctcccctctttctctcccacaatacacataggtacacactctcatnatgcacatacatgtacacatacatgcatatt

SEQ ID NO: 344289 - DNA, 6016 bp, Homo sapiens
gactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtggtgagatccagaaacctgctgatctacgaggaacattctcccccagaggagtcatccagcccgggctcggctggggagctggggggctgggatagaggttcctccctgctcagggtgtcagggctggagtccaggccggatgtggatcttccccatttcattatctcgaatgagaccagcctggagaagtcagtgcttttggagctgcagcagcacctggtcagcgccaaactggaggggaatgaaacactaaaagttgtagaactcgacagaagagtgaacaccactttctaaagaggctgcctgcaccccctccctttcccttaactctacttttacatccccaaaccacctttgtcatcagcttttcctctttgccactggatcttcatggagacatgggcaagcattagtggcttcagattggagaccagcctgggacttccctgcagtgagagagcatctccccctggtccatgcccctcctgtgcagaagggagcctgcatccctcccttcctttctcttactgccataggaaattattttaggggttggaggtgggacaagcaggcttgtttccaccaatagtgccaaaaagatattgcctaatgtgcacctgtgaggtgtaaccccccgctttggagacgagatggctcttgttcagtcaagaccccagactctggccacaaaaatgccataatgcctgttggtatttggcaaagcactgacccgtgtcctccgttgctcgcactggggtctctggtgtgaacacccccgacagcagccctccgcccactctgccccctgggagccctcgctggatcgtctcgtctcctgcagcagcactggcaggcgagggctctcgttcatattctcaggccgcaagtgcaatgcctgaggggatcaggcttttctactccaggcaaacctgccccatcttgtcgcttttaggacctcccacaacctggttccccacacatccatagttctgcctccccagcttctcctccccagttgtaaatagtatttattagcttgccgaggcttcctgctagcaaccacactgaagagatcgatgcctcctttcaagctagccaagttttctgcgagccttcagagctaggagggcaccctaggctctgggatcccgtgtctttccagacaatgttttgtttcctttcctttgttttttcttttaactggaataattaccattgaaaaagaagttcctttgagcatgtatgtgtctgcctctaggatgagctcagagcgagagatgacacaatgcctcactcaggccccgggctccctggccacaagctttttctatcctgttttcatgacagagaaggggaagccctgttctgacaacagacatttcagacaaccttgctggctttccacacctgcctggccccctcctccctccacacttccactttgtcctcctcgtcccctacctcaacaaagcagggtggggtaggtgacatttgtgtatccacattcttacctttggtagtcaggtttggctactttgcagctcgcccaaagagatacaacctaatccccaacctacttttagtttttttgttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattccatatcaggtacaggatttgatgttattaacatttgtcgtcatacctcataagtcggtccctgccttgtctgtctaggcccatttggggctccctgtgagtgattcccctctctctgctatgctggagacggttccagcctggaaagcggccaagttcatcttctcactgtgagtggaagctggatcgggcccccgtagtcctggcagccctgttgtctggagggttcttgttgtccctcccattagccagggcggagactgtctgagctgtgcaggaggagggttgctagtaggttctgcttctgcttctctctgctccactgtctgcagcccagatcctgttgggcctggctggtgtctggtaaccatgggcctccactgacccatccctctcttttaaactgtcaggtcattatcaggcataggcagcctatagggcccaaagaaggcaaaaagataagatttactcaagtagcatttgggcaatgaggaaggaaaggtttcaaatttaggggcagaagtgagagaatgagccaacccatgtacctgctgcaactgaaccagactgggttttcaaggctcccagacgtagagtaggaaacgtgctcttctaaatgaggagggagaagataaaggaaacttctagcccctgtccttagtgctttgaggattttattttctcccttactacgcttgcttgacgtcactctctctcgacctccaaacagcaggactctttctctgggaaaccatccttccaaaacggaatctatgtagacaatgggacgttaggcagagagctcagatggcccttttaagggggctccaagaaccaacatcactgctcttttagataaacctctgccctccactccttgcttgagtgggttaaaggaactaacagttgtccctttaggaggacaaaatggggtcaagaggacacagaagagttgtatagcaccagattggttccaaatagttaatggatgtgtgcacattttctgttcagggattaagaccagaatatcagtggatttgttttccccaccaagtggcctcttagactagtcattaacttatgattagctctaaagatttcaaatagtggcagacagtgtcttctgaatgtaagttttgagaaatacgagtctgtcagagcggccataagccataaagagtcaatctcttaattatatttttcatcatgtaaacaagtttcccatttccctttcttagattgcaccagtgaaggagatgttttgcaaagattcagagaactaatttttcactggataagacctgagtaacccagaccccccaccgtggttcttttcacagccctcgactttgcacttaaaaagggatattgtaaatgaaaggctgcagtgccagttttaagaaagaatttctgtgaagtgtgaggactctggagtctagctcacataaagagagtgttatataaaaatccgacagctgaactaggttgctcttttttggcagggagtggggatgagatttgacaccaatatgggcaaaattagataaccttttggttaatataaatgattttgatttggaggcctaatttgtagattgtgaaagcagcttttagtttaacttattcacagaccccttataattaccatgtttttttttttcttcctaaatctcttggttcagcttgtgaatcttacgtgcccgtaaagttgggatgttgaattggctcttctttgttctggcagtgagtcaagtgtccagcattttttcataagtgttttttaaaattgttctccagcattttatggctcctccctcccatgtcctcagacccagcaaaagcgtagaggcagaattagaggcctctccaggccagctcctctgcccacatgtcatacaaggtgtgaatttgagcacagtccagaaatggagacatcccacccccagttgaataatggcccattcatgccaaccttgccaacacggagagggcagagatgcactagaagaccttcatcctccccttcctctgccccaagtcactacagttggttctattgaagccagtctttaagaaacctgggttaaagacaccagcacttctgcttgctgggctggctggacctgtgaagccatgggcaggtagtgccctcttgagagtcattttatttggccaccttcaggtgagactatccatagacacatgctaggataggccccgctgggagggcagttacaggagagagtaggtggtggtgacgtgagggctgtgaaggatccagagacaagacttagatgtttcgttcattcactcactcattcagttactcctaagacttttcagtttcataaggaagagtgttgcctgaggccctagggaatattggggaatagaagggattgaggaaacattaataatagttattcaaaagacccaaatgcttatacttctctctcccttcttctctctctgacacacacacacacacacacacacacacacacacacacgtgcacattcctcccttacatgctcatttgtgccttaaatgtgccttataggtaaatccaggatgactgaggaatccctcgtcactgggagattttgtatatattcttttattattagattgagttgggtgtggggaaaaatttttttctgaaggctcaaaagtggtttcctaaaagtgagccactatcagatttgcacatcaggagaaaagaaatagggttacgtccattaggaaaatcccagtttgcaggagtgcaatcacatcaaaaaaacaaccagccaggattaaaggtattataaatcctcatagcggaacatttctcagggcaaaggaacctggctcatttgaagattaatgttccatgcctttgtggtcaaagggtcagcacttaacacaggaaaaaactaggtgttgttttgttttgttattttggacaacataaaattcaggaatgttttatttagccttggtttctagaaggaagggaaataatatttcttgagcatttactagggtgttgcgtgctgtgctaagtaaattttaagtctttcagttttatagatacggaaaacaagggtgactctttaccacaggatgaataaagaactaagtaatatgggaaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaataccaaaaaaaaaaaaaagctttgtaggacacttgtacttagtttgggaaaaaaaaataaattgaaattgttatgcttttgtatttccatttcttgcaaataaatattttttcttaaatagta

SEQ ID NO: 344290 - DNA, 6048 bp, Homo sapiens
gactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtggtgagatccagaaacctgctgatctacgaggaacattctcccccagaggagtcatccagcccgggctcggctggggagctggggggctgggatagaggttcctccctgctcagggtgtcagggctggagtccaggccggatgtggatcttccccatttcattatctcgaatgagaccagcctggagaagtcagtgcttttggagctgcagcagcacctggtcagcgccaaactggaggggaatgaaacactaaaagttgtagaactcgacagaagagtgaacaccactttctaaagaggctgcctgcaccccctccctttcccttaactctacttttacatccccaaaccacctttgtcatcagcttttcctctttgccactggatcttcatggagacatgggcaagcattagtggcttcagattggagaccagcctgggacttccctgcagtgagagagcatctccccctggtccatgcccctcctgtgcagaagggagcctgcatccctcccttcctttctcttactgccataggaaattattttaggggttggaggtgggacaagcaggcttgtttccaccaatagtgccaaaaagatattgcctaatgtgcacctgtgaggtgtaaccccccgctttggagacgagatggctcttgttcagtcaagaccccagactctggccacaaaaatgccataatgcctgttggtatttggcaaagcactgacccgtgtcctccgttgctcgcactggggtctctggtgtgaacacccccgacagcagccctccgcccactctgccccctgggagccctcgctggatcgtctcgtctcctgcagcagcactggcaggcgagggctctcgttcatattctcaggccgcaagtgcaatgcctgaggggatcaggcttttctactccaggcaaacctgccccatcttgtcgcttttaggacctcccacaacctggttccccacacatccatagttctgcctccccagcttctcctccccagttgtaaatagtatttattagcttgccgaggcttcctgctagcaaccacactgaagagatcgatgcctcctttcaagctagccaagttttctgcgagccttcagagctaggagggcaccctaggctctgggatcccgtgtctttccagacaatgttttgtttcctttcctttgttttttcttttaactggaataattaccattgaaaaagaagttcctttgagcatgtatgtgtctgcctctaggatgagctcagagcgagagatgacacaatgcctcactcaggccccgggctccctggccacaagctttttctatcctgttttcatgacagagaaggggaagccctgttctgacaacagacatttcagacaaccttgctggctttccacacctgcctggccccctcctccctccacacttccactttgtcctcctcgtcccctacctcaacaaagcagggtggggtaggtgacatttgtgtatccacattcttacctttggtagtcaggtttggctactttgcagctcgcccaaagagatacaacctaatccccaacctacttttagtttttttgttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattccatatcaggtacaggatttgatgttattaacatttgtcgtcatacctcataagtcggtccctgccttgtctgtctaggcccatttggggctccctgtgagtgattcccctctctctgctatgctggagacggttccagcctggaaagcggccaagttcatcttctcactgtgagtggaagctggatcgggcccccgtagtcctggcagccctgttgtctggagggttcttgttgtccctcccattagccagggcggagactgtctgagctgtgcaggaggagggttgctagtaggttctgcttctgcttctctctgctccactgtctgcagcccagatcctgttgggcctggctggtgtctggtaaccatgggcctccactgacccatccctctcttttaaactgtcaggtcattatcaggcataggcagcctatagggcccaaagaaggcaaaaagataagatttactcaagtagcatttgggcaatgaggaaggaaaggtttcaaatttaggggcagaagtgagagaatgagccaacccatgtacctgctgcaactgaaccagactgggttttcaaggctcccagacgtagagtaggaaacgtgctcttctaaatgaggagggagaagataaaggaaacttctagcccctgtccttagtgctttgaggattttattttctcccttactacgcttgcttgacgtcactctctctcgacctccaaacagcaggactctttctctgggaaaccatccttccaaaacggaatctatgtagacaatgggacgttaggcagagagctcagatggcccttttaagggggctccaagaaccaacatcactgctcttttagataaacctctgccctccactccttgcttgagtgggttaaaggaactaacagttgtccctttaggaggacaaaatggggtcaagaggacacagaagagttgtatagcaccagattggttccaaatagttaatggatgtgtgcacattttctgttcagggattaagaccagaatatcagtggatttgttttccccaccaagtggcctcttagactagtcattaacttatgattagctctaaagatttcaaatagtggcagacagtgtcttctgaatgtaagttttgagaaatacgagtctgtcagagcggccataagccataaagagtcaatctcttaattatatttttcatcatgtaaacaagtttcccatttccctttcttagattgcaccagtgaaggagatgttttgcaaagattcagagaactaatttttcactggataagacctgagtaacccagaccccccaccgtggttcttttcacagccctcgactttgcacttaaaaagggatattgtaaatgaaaggctgcagtgccagttttaagaaagaatttctgtgaagtgtgaggactctggagtctagctcacataaagagagtgttatataaaaatccgacagctgaactaggttgctcttttttggcagggagtggggatgagatttgacaccaatatgggcaaaattagataaccttttggttaatataaatgattttgatttggaggcctaatttgtagattgtgaaagcagcttttagtttaacttattcacagaccccttataattaccatgtttttttttttcttcctaaatctcttggttcagcttgtgaatcttacgtgcccgtaaagttgggatgttgaattggctcttctttgttctggcagtgagtcaagtgtccagcattttttcataagtgttttttaaaattgttctccagcattttatggctcctccctcccatgtcctcagacccagcaaaagcgtagaggcagaattagaggcctctccaggccagctcctctgcccacatgtcatacaaggtgtgaatttgagcacagtccagaaatggagacatcccacccccagttgaataatggcccattcatgccaaccttgccaacacggagagggcagagatgcactagaagaccttcatcctccccttcctctgccccaagtcactacagttggttctattgaagccagtctttaagaaacctgggttaaagacaccagcacttctgcttgctgggctggctggacctgtgaagccatgggcaggtagtgccctcttgagagtcattttatttggccaccttcaggtgagactatccatagacacatgctaggataggccccgctgggagggcagttacaggagagagtaggtggtggtgacgtgagggctgtgaaggatccagagacaagacttagatgtttcgttcattcactcactcattcagttactcctaagacttttcagtttcataaggaagagtgttgcctgaggccctagggaatattggggaatagaagggattgaggaaacattaataatagttattcaaaagacccaaatgcttatacttctctctcccttcttctctctctgacacacacacacacacacacacacacacacacacacacgtgcacattcctcccttacatgctcatttgtgccttaaatgtgccttataggtaaatccaggatgactgaggaatccctcgtcactgggagattttgtatatattcttttattattagattgagttgggtgtggggaaaaatttttttctgaaggctcaaaagtggtttcctaaaagtgagccactatcagatttgcacatcaggagaaaagaaatagggttacgtccattaggaaaatcccagtttgcaggagtgcaatcacatcaaaaaaacaaccagccaggattaaaggtattataaatcctcatagcggaacatttctcagggcaaaggaacctggctcatttgaagattaatgttccatgcctttgtggtcaaagggtcagcacttaacacaggaaaaaactaggtgttgttttgttttgttattttggacaacataaaattcaggaatgttttatttagccttggtttctagaaggaagggaaataatatttcttgagcatttactagggtgttgcgtgctgtgctaagtaaattttaagtctttcagttttatagatacggaaaacaagggtgactctttaccacaggatgaataaagaactaagtaatatgggaaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaataccaaaaaaaaaaaaaagctttgtaggacacttgtacttagtttgggaaaaaaaaataaattgaaattgttatgcttttgtatttccatttcttgcaaataaatattttttcttaaatagtaagatgttgcccagtctttataatcttggtact

SEQ ID NO: 344291 - DNA, 6458 bp, Homo sapiens
gactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtggtgagatccagaaacctgctgatctacgaggaacattctcccccagaggagtcatccagcccgggctcggctggggagctggggggctgggatagaggttcctccctgctcagggtgtcagggctggagtccaggccggatgtggatcttccccatttcattatctcgaatgagaccagcctggagaagtcagtgcttttggagctgcagcagcacctggtcagcgccaaactggaggggaatgaaacactaaaagttgtagaactcgacagaagagtgaacaccactttctaaagaggctgcctgcaccccctccctttcccttaactctacttttacatccccaaaccacctttgtcatcagcttttcctctttgccactggatcttcatggagacatgggcaagcattagtggcttcagattggagaccagcctgggacttccctgcagtgagagagcatctccccctggtccatgcccctcctgtgcagaagggagcctgcatccctcccttcctttctcttactgccataggaaattattttaggggttggaggtgggacaagcaggcttgtttccaccaatagtgccaaaaagatattgcctaatgtgcacctgtgaggtgtaaccccccgctttggagacgagatggctcttgttcagtcaagaccccagactctggccacaaaaatgccataatgcctgttggtatttggcaaagcactgacccgtgtcctccgttgctcgcactggggtctctggtgtgaacacccccgacagcagccctccgcccactctgccccctgggagccctcgctggatcgtctcgtctcctgcagcagcactggcaggcgagggctctcgttcatattctcaggccgcaagtgcaatgcctgaggggatcaggcttttctactccaggcaaacctgccccatcttgtcgcttttaggacctcccacaacctggttccccacacatccatagttctgcctccccagcttctcctccccagttgtaaatagtatttattagcttgccgaggcttcctgctagcaaccacactgaagagatcgatgcctcctttcaagctagccaagttttctgcgagccttcagagctaggagggcaccctaggctctgggatcccgtgtctttccagacaatgttttgtttcctttcctttgttttttcttttaactggaataattaccattgaaaaagaagttcctttgagcatgtatgtgtctgcctctaggatgagctcagagcgagagatgacacaatgcctcactcaggccccgggctccctggccacaagctttttctatcctgttttcatgacagagaaggggaagccctgttctgacaacagacatttcagacaaccttgctggctttccacacctgcctggccccctcctccctccacacttccactttgtcctcctcgtcccctacctcaacaaagcagggtggggtaggtgacatttgtgtatccacattcttacctttggtagtcaggtttggctactttgcagctcgcccaaagagatacaacctaatccccaacctacttttagtttttttgttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattccatatcaggtacaggatttgatgttattaacatttgtcgtcatacctcataagtcggtccctgccttgtctgtctaggcccatttggggctccctgtgagtgattcccctctctctgctatgctggagacggttccagcctggaaagcggccaagttcatcttctcactgtgagtggaagctggatcgggcccccgtagtcctggcagccctgttgtctggagggttcttgttgtccctcccattagccagggcggagactgtctgagctgtgcaggaggagggttgctagtaggttctgcttctgcttctctctgctccactgtctgcagcccagatcctgttgggcctggctggtgtctggtaaccatgggcctccactgacccatccctctcttttaaactgtcaggtcattatcaggcataggcagcctatagggcccaaagaaggcaaaaagataagatttactcaagtagcatttgggcaatgaggaaggaaaggtttcaaatttaggggcagaagtgagagaatgagccaacccatgtacctgctgcaactgaaccagactgggttttcaaggctcccagacgtagagtaggaaacgtgctcttctaaatgaggagggagaagataaaggaaacttctagcccctgtccttagtgctttgaggattttattttctcccttactacgcttgcttgacgtcactctctctcgacctccaaacagcaggactctttctctgggaaaccatccttccaaaacggaatctatgtagacaatgggacgttaggcagagagctcagatggcccttttaagggggctccaagaaccaacatcactgctcttttagataaacctctgccctccactccttgcttgagtgggttaaaggaactaacagttgtccctttaggaggacaaaatggggtcaagaggacacagaagagttgtatagcaccagattggttccaaatagttaatggatgtgtgcacattttctgttcagggattaagaccagaatatcagtggatttgttttccccaccaagtggcctcttagactagtcattaacttatgattagctctaaagatttcaaatagtggcagacagtgtcttctgaatgtaagttttgagaaatacgagtctgtcagagcggccataagccataaagagtcaatctcttaattatatttttcatcatgtaaacaagtttcccatttccctttcttagattgcaccagtgaaggagatgttttgcaaagattcagagaactaatttttcactggataagacctgagtaacccagaccccccaccgtggttcttttcacagccctcgactttgcacttaaaaagggatattgtaaatgaaaggctgcagtgccagttttaagaaagaatttctgtgaagtgtgaggactctggagtctagctcacataaagagagtgttatataaaaatccgacagctgaactaggttgctcttttttggcagggagtggggatgagatttgacaccaatatgggcaaaattagataaccttttggttaatataaatgattttgatttggaggcctaatttgtagattgtgaaagcagcttttagtttaacttattcacagaccccttataattaccatgtttttttttttcttcctaaatctcttggttcagcttgtgaatcttacgtgcccgtaaagttgggatgttgaattggctcttctttgttctggcagtgagtcaagtgtccagcattttttcataagtgttttttaaaattgttctccagcattttatggctcctccctcccatgtcctcagacccagcaaaagcgtagaggcagaattagaggcctctccaggccagctcctctgcccacatgtcatacaaggtgtgaatttgagcacagtccagaaatggagacatcccacccccagttgaataatggcccattcatgccaaccttgccaacacggagagggcagagatgcactagaagaccttcatcctccccttcctctgccccaagtcactacagttggttctattgaagccagtctttaagaaacctgggttaaagacaccagcacttctgcttgctgggctggctggacctgtgaagccatgggcaggtagtgccctcttgagagtcattttatttggccaccttcaggtgagactatccatagacacatgctaggataggccccgctgggagggcagttacaggagagagtaggtggtggtgacgtgagggctgtgaaggatccagagacaagacttagatgtttcgttcattcactcactcattcagttactcctaagacttttcagtttcataaggaagagtgttgcctgaggccctagggaatattggggaatagaagggattgaggaaacattaataatagttattcaaaagacccaaatgcttatacttctctctcccttcttctctctctgacacacacacacacacacacacacacacacacacacacgtgcacattcctcccttacatgctcatttgtgccttaaatgtgccttataggtaaatccaggatgactgaggaatccctcgtcactgggagattttgtatatattcttttattattagattgagttgggtgtggggaaaaatttttttctgaaggctcaaaagtggtttcctaaaagtgagccactatcagatttgcacatcaggagaaaagaaatagggttacgtccattaggaaaatcccagtttgcaggagtgcaatcacatcaaaaaaacaaccagccaggattaaaggtattataaatcctcatagcggaacatttctcagggcaaaggaacctggctcatttgaagattaatgttccatgcctttgtggtcaaagggtcagcacttaacacaggaaaaaactaggtgttgttttgttttgttattttggacaacataaaattcaggaatgttttatttagccttggtttctagaaggaagggaaataatatttcttgagcatttactagggtgttgcgtgctgtgctaagtaaattttaagtctttcagttttatagatacggaaaacaagggtgactctttaccacaggatgaataaagaactaagtaatatgggaaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaataccaaaaaaaaaaaaaagctttgtaggacacttgtacttagtgggggcaacaacacaaacttacactctgcgacattgcgtcaggccttgggattttcccatttcctggccaattaactttttctttcctaaaattggttacacaaaaacaaacaacaacaaacaacaccacacgaaaaacacacaacacctacaatcacacacaaacacaaaacaaccacaaacaaagaacacccgtgttgcggcggcgccgcgcgggcccgccaggagagagctttcttagagaacaacacggtggggaggcgcggggccgcccccagaggggtgacgacaaccaacgagccagcaccgagcgtcgctcctcaagagaagaaactgtcccgcgcgacagcatagcgggggggacgagtgaccccccgcacaagaaaaagaagcgccgggcgggggacaacgacgcgcgccgtcgcgacacaacacccgcagaggggactcgatggggaggcataccgcggcggactaccccagagggagtctctgcgcgggcgcgagaatataaaaccgcgg

SEQ ID NO: 344292 - DNA, 5897 bp, Homo sapiens
gactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtggtgagatccagaaacctgctgatctacgaggaacattctcccccagaggagtcatccagcccgggctcggctggggagctggggggctgggatagaggttcctccctgctcagggtgtcagggctggagtccaggccggatgtggatcttccccatttcattatctcgaatgagaccagcctggagaagtcagtgcttttggagctgcagcagcacctggtcagcgccaaactggaggggaatgaaacactaaaagttgtagaactcgacagaagagtgaacaccactttctaaagaggctgcctgcaccccctccctttcccttaactctacttttacatccccaaaccacctttgtcatcagcttttcctctttgccactggatcttcatggagacatgggcaagcattagtggcttcagattggagaccagcctgggacttccctgcagtgagagagcatctccccctggtccatgcccctcctgtgcagaagggagcctgcatccctcccttcctttctcttactgccataggaaattattttaggggttggaggtgggacaagcaggcttgtttccaccaatagtgccaaaaagatattgcctaatgtgcacctgtgaggtgtaaccccccgctttggagacgagatggctcttgttcagtcaagaccccagactctggccacaaaaatgccataatgcctgttggtatttggcaaagcactgacccgtgtcctccgttgctcgcactggggtctctggtgtgaacacccccgacagcagccctccgcccactctgccccctgggagccctcgctggatcgtctcgtctcctgcagcagcactggcaggcgagggctctcgttcatattctcaggccgcaagtgcaatgcctgaggggatcaggcttttctactccaggcaaacctgccccatcttgtcgcttttaggacctcccacaacctggttccccacacatccatagttctgcctccccagcttctcctccccagttgtaaatagtatttattagcttgccgaggcttcctgctagcaaccacactgaagagatcgatgcctcctttcaagctagccaagttttctgcgagccttcagagctaggagggcaccctaggctctgggatcccgtgtctttccagacaatgttttgtttcctttcctttgttttttcttttaactggaataattaccattgaaaaagaagttcctttgagcatgtatgtgtctgcctctaggatgagctcagagcgagagatgacacaatgcctcactcaggccccgggctccctggccacaagctttttctatcctgttttcatgacagagaaggggaagccctgttctgacaacagacatttcagacaaccttgctggctttccacacctgcctggccccctcctccctccacacttccactttgtcctcctcgtcccctacctcaacaaagcagggtggggtaggtgacatttgtgtatccacattcttacctttggtagtcaggtttggctactttgcagctcgcccaaagagatacaacctaatccccaacctacttttagtttttttgttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattccatatcaggtacaggatttgatgttattaacatttgtcgtcatacctcataagtcggtccctgccttgtctgtctaggcccatttggggctccctgtgagtgattcccctctctctgctatgctggagacggttccagcctggaaagcggccaagttcatcttctcactgtgagtggaagctggatcgggcccccgtagtcctggcagccctgttgtctggagggttcttgttgtccctcccattagccagggcggagactgtctgagctgtgcaggaggagggttgctagtaggttctgcttctgcttctctctgctccactgtctgcagcccagatcctgttgggcctggctggtgtctggtaaccatgggcctccactgacccatccctctcttttaaactgtcaggtcattatcaggcataggcagcctatagggcccaaagaaggcaaaaagataagatttactcaagtagcatttgggcaatgaggaaggaaaggtttcaaatttaggggcagaagtgagagaatgagccaacccatgtacctgctgcaactgaaccagactgggttttcaaggctcccagacgtagagtaggaaacgtgctcttctaaatgaggagggagaagataaaggaaacttctagcccctgtccttagtgctttgaggattttattttctcccttactacgcttgcttgacgtcactctctctcgacctccaaacagcaggactctttctctgggaaaccatccttccaaaacggaatctatgtagacaatgggacgttaggcagagagctcagatggcccttttaagggggctccaagaaccaacatcactgctcttttagataaacctctgccctccactccttgcttgagtgggttaaaggaactaacagttgtccctttaggaggacaaaatggggtcaagaggacacagaagagttgtatagcaccagattggttccaaatagttaatggatgtgtgcacattttctgttcagggattaagaccagaatatcagtggatttgttttccccaccaagtggcctcttagactagtcattaacttatgattagctctaaagatttcaaatagtggcagacagtgtcttctgaatgtaagttttgagaaatacgagtctgtcagagcggccataagccataaagagtcaatctcttaattatatttttcatcatgtaaacaagtttcccatttccctttcttagattgcaccagtgaaggagatgttttgcaaagattcagagaactaatttttcactggataagacctgagtaacccagaccccccaccgtggttcttttcacagccctcgactttgcacttaaaaagggatattgtaaatgaaaggctgcagtgccagttttaagaaagaatttctgtgaagtgtgaggactctggagtctagctcacataaagagagtgttatataaaaatccgacagctgaactaggttgctcttttttggcagggagtggggatgagatttgacaccaatatgggcaaaattagataaccttttggttaatataaatgattttgatttggaggcctaatttgtagattgtgaaagcagcttttagtttaacttattcacagaccccttataattaccatgtttttttttttcttcctaaatctcttggttcagcttgtgaatcttacgtgcccgtaaagttgggatgttgaattggctcttctttgttctggcagtgagtcaagtgtccagcattttttcataagtgttttttaaaattgttctccagcattttatggctcctccctcccatgtcctcagacccagcaaaagcgtagaggcagaattagaggcctctccaggccagctcctctgcccacatgtcatacaaggtgtgaatttgagcacagtccagaaatggagacatcccacccccagttgaataatggcccattcatgccaaccttgccaacacggagagggcagagatgcactagaagaccttcatcctccccttcctctgccccaagtcactacagttggttctattgaagccagtctttaagaaacctgggttaaagacaccagcacttctgcttgctgggctggctggacctgtgaagccatgggcaggtagtgccctcttgagagtcattttatttggccaccttcaggtgagactatccatagacacatgctaggataggccccgctgggagggcagttacaggagagagtaggtggtggtgacgtgagggctgtgaaggatccagagacaagacttagatgtttcgttcattcactcactcattcagttactcctaagacttttcagtttcataaggaagagtgttgcctgaggccctagggaatattggggaatagaagggattgaggaaacattaataatagttattcaaaagacccaaatgcttatacttctctctcccttcttctctctctgacacacacacacacacacacacacacacacacacacacgtgcacattcctcccttacatgctcatttgtgccttaaatgtgccttataggtaaatccaggatgactgaggaatccctcgtcactgggagattttgtatatattcttttattattagattgagttgggtgtggggaaaaatttttttctgaaggctcaaaagtggtttcctaaaagtgagccactatcagatttgcacatcaggagaaaagaaatagggttacgtccattaggaaaatcccagtttgcaggagtgcaatcacatcaaaaaaacaaccagccaggattaaaggtattataaatcctcatagcggaacatttctcagggcaaaggaacctggctcatttgaagattaatgttccatgcctttgtggtcaaagggtcagcacttaacacaggaaaaaactaggtgttgttttgttttgttattttggacaacataaaattcaggaatgttttatttagccttggtttctagaaggaagggaaataatatttcttgagcatttactagggtgttgcgtgctgtgctaagtaaattttaagtctttcagttttatagatacggaaaacaagggtgactctttaccacaggatgaataaagaactaagtaatatgggaaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaagccgcggtccctccttcagcgcagcgcgtaccagtggctcagcaagaacaggcgtggacatccaggtaccaagctcgcacacaggtatccgctcagccgtgcactaggaatttgatcgcaccaggccatatatgggtcagcggcaaaagcctgtcttcgtcctccgggacgtcattcagcagtagcgcaagtcgataacacactcgttatcgcc

SEQ ID NO: 344293 - DNA, 480 bp, Homo sapiens
gcggccgcctactactactactgctcgaattcaagcttctaacgatgtacggggacatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaataccaaaaaaaaaaaaaagctttgtaggacacttgtacttagtttgggaaaaaaaaataaattgaaattgttatgcttttgtatttccatttcttgcaaataaatattttttcttaaatagta

SEQ ID NO: 344294 - DNA, 1188 bp, Homo sapiens
  misc_feature (350)..(350): n is a, c, g, or t
gactctccttcagcaactccagaagcttcagactttggtgatgggcaaggtttctcgaacctgcaagttagctggcacgcagactggcacctgcctcatggtgagcttcccagcagggtagcacagtgaccgcccctgcctggcccctgtctcccctctccctccacttgccaaggccaagtgctgtgctgtaggagaaaccacatggaggaactccactctgaggctgttcctcggtgaggcactctggtgatgtgactggtgggtgcagtccactggcctgaagaggagagtctgtgtccctgggtataaagctgtgctgtccagaggctgaagtccacagcccctcngtgttctctctcccctctttctctcccacaagttgtggtgctgtgctttgccgttgcattcggcagcttctttcaaggctacgggccctatccttctgccaccaagatggctctgcccagccagcattccctgcaggagccctacacagcctccgtggtgagatccagaaacctgctgatctacgaggaacattctcccccagaggagtcatccagcccgggctcggctggggagctggggggctgggatagaggttcctccctgctcagggtgtcagggctggagtccaggccggatgtggatcttccccatttcattatctcgaatgagaccagcctggagaagtcagtgcttttggagctgcagcagcacctgtgagtcatagagacacagagccaactcctctagtgcactgatggtgggttatgagtcagcaacctgagatgtgaggttgagactctccataggcctggttcagtccctcagctctctcaggacctatttccaggacctgggactgcagagagtctgttgctggccaacagttgccctgagcagagatgaggaaaaaaaccagcgtgagctcccctatgtctgctgcatcagcggggagctggcgtggtggcacaaagaagtgcttgaatcccttcccccactgtctccatcctcccttccaagccacacgagtgaatgcacagcccaggtaaccacagtgtgtttgctgtgcaaatccaactttaagacatgtttcatggcttcaactagggagtagatatatattgtgctatatgtcaatatatgtttatgatttatatgtaaatacacatgtgttaatta

SEQ ID NO: 344295 - DNA, 3303 bp, Homo sapiens
gactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtggtgagatccagaaacctgctgatctacgaggaacattctcccccagaggagtcatccagcccgggctcggctggggagctggggggctgggatagaggttcctccctgctcagggtgtcagggctggagtccaggccggatgtggatcttccccatttcattatctcgaatgagaccagcctggagaagtcagtgcttttggagctgcagcagcacctggtcagcgccaaactggaggggaatgaaacactaaaagttgtagaactcgacagaagagtgaacaccactttctaaagaggctgcctgcaccccctccctttcccttaactctacttttacatccccaaaccacctttgtcatcagcttttcctctttgccactggatcttcatggagacatgggcaagcattagtggcttcagattggagaccagcctgggacttccctgcagtgagagagcatctccccctggtccatgcccctcctgtgcagaagggagcctgcatccctcccttcctttctcttactgccataggaaattattttaggggttggaggtgggacaagcaggcttgtttccaccaatagtgccaaaaagatattgcctaatgtgcacctgtgaggtgtaaccccccgctttggagacgagatggctcttgttcagtcaagaccccagactctggccacaaaaatgccataatgcctgttggtatttggcaaagcactgacccgtgtcctccgttgctcgcactggggtctctggtgtgaacacccccgacagcagccctccgcccactctgccccctgggagccctcgctggatcgtctcgtctcctgcagcagcactggcaggcgagggctctcgttcatattctcaggccgcaagtgcaatgcctgaggggatcaggcttttctactccaggcaaacctgccccatcttgtcgcttttaggacctcccacaacctggttccccacacatccatagttctgcctccccagcttctcctccccagttgtaaatagtatttattagcttgccgaggcttcctgctagcaaccacactgaagagatcgatgcctcctttcaagctagccaagttttctgcgagccttcagagctaggagggcaccctaggctctgggatcccgtgtctttccagacaatgttttgtttcctttcctttgttttttcttttaactggaataattaccattgaaaaagaagttcctttgagcatgtatgtgtctgcctctaggatgagctcagagcgagagatgacacaatgcctcactcaggccccgggctccctggccacaagctttttctatcctgttttcatgacagagaaggggaagccctgttctgacaacagacatttcagacaaccttgctggctttccacacctgcctggccccctcctccctccacacttccactttgtcctcctcgtcccctacctcaacaaagcagggtggggtaggtgacatttgtgtatccacattcttacctttggtagtcaggtttggctactttgcagctcgcccaaagagatacaacctaatccccaacctacttttagtttttttgttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattccatatcaggtacaggatttgatgttattaacatttgtcgtcatacctcataagtcggtccctgccttgtctgtctaggcccatttggggctccctgtgagtgattcccctctctctgctatgctggagacggttccagcctggaaagcggccaagttcatcttctcactgtgagtggaagctggatcgggcccccgtagtcctggcagccctgttgtctggagggttcttgttgtccctcccattagccagggcggagactgtctgagctgtgcaggaggagggttgctagtaggttctgcttctgcttctctctgctccactgtctgcagcccagatcctgttgggcctggctggtgtctggtaaccatgggcctccactgacccatccctctcttttaaactgtcaggtcattatcaggcataggcagcctatagggcccaaagaaggcaaaaagataagatttactcaagtagcatttgggcaatgaggaaggaaaggtttcaaatttaggggcagaagtgagagaatgagccaacccatgtacctgctgcaactgaaccagactgggttttcaaggctcccagacgtagagtaggaaacgtgctcttctaaatgaggagggagaagataaaggaaacttctagcccctgtccttagtgctttgaggattttattttctcccttactacgcttgcttgacgtcactctctctcgacctccaaacagcaggactctttctctgggaaaccatccttccaaaacggaatctatgtagacaatgggacgttaggcagagagctcagatggcccttttaagggggctccaagaaccaacatcactgctcttttagataaacctctgccctccactccttgcttgagtgggttaaaggaactaacagttgtccctttaggaggacaaaatggggtcaagaggacacagaagagttgtatagcaccagattggttccaaatagttaatggatgtgtgcacattttctgttcagggattaagaccagaatatcagtggatttgttttccccaccaagtggcctcttagactaggctacgttctaaagcatcagtgtctggagattgcggatactatgttacatcaagaataactatgagccgagtacgatcg

SEQ ID NO: 344296 - DNA, 520 bp, Homo sapiens
gtctgtgagaacatgtctgtagtcatctaaaccattaaagttagaatggaataggaaaaattccagggtttaccttgatttccattgtcaataaaaatttagttctctggaagtagttttgtggttgtggtgggagacataggaagatgatatatggagggcaggtgttagctttcatattttgtgcgttttgtgtttctttcagtaagtgagacagattatttaaaagtatactgaatttacatagctttttgtgggggagggggtaaaggaattcaaatcacttcacttatatcatctcatccattcttaaaagatgagtgtgaaaacaggtgaggtgcattcacgatggttcttttcaagacagttacaaaccatgagcattctaaagaaatccagaggaaaggtaggccataagaactcaggactttaggtgttgtggcctaggaggttctatcctgacctgatcactcacctcttctcacctattcttcagatactctgtgaagatttactccta

SEQ ID NO: 344297 - DNA, 645 bp, Homo sapiens
gcccggacatgaccttggacaagtcgctgaactcggggacctctgtttccttatctgtcagctgaggccacaaggactgcatgatctcgcagctgccttccagaaacaacattccagaatgctctgttccccccttccagcccaagagactgtgcagaataggcctcttctcagtcagcaggcacttttgtctcccatggtctaggcaggagtcatttttttttgctacagtggtggaaatgggtcaggctggagaatgctgaggtttccaggctagtggtttcttcctctgaccacagtaagaggaaaggaagctttccctccacctctactcctctgtgactcctgccccagccccatcctcagcttccacctaagaggtagtgcaggaaagtggtgataagcagatgtctgcagctgtgtgacgtgtgtcccagcccagttctgtggcctgctacctggggagcctctggttgtcattgggcctcctgttgcctctcagcttgcctccctctgtaaaatggggacagtaggccaggggctgtggctcacacctgtaatctcaacactttgggaggccaaggcaggtggatctcctgaggtcaggagttcaagaccagcctgaccaatatggtgaaaccccat

SEQ ID NO: 344298 - DNA, 246 bp, Homo sapiens
cgtatggtataagtgaaataattcctaattgcagaatactcttttgtgagcttcattaagaaagtagggatcttggctgggtgcagtggcccacgcctgtaatcccagcactttaggaggccaagtctggcggatcacctgaggtcaggagtttcagaccagcctgaccaatgtggaggaaccccgtctctactaaaaatacaaaattagccggatgtagtggtgcatgcctgtaatcgtagctac

SEQ ID NO: 344299 - DNA, 639 bp, Homo sapiens
gtaataaaccacacagctcatgcacccagaaggtcatgataagtgaacagaatgtagaggaggggtcagcccctaaaaggggagaaagtttcattattgggaaatcgaaactgaagtggggaaagggaccacggtataaccttataagggggataataaaacttaggcaatgtccaggaagattgtaaccccatagtactcaaccaatgaggagctgggggagggacttgcgtgctaggagataaattacctgttgtaactgtccccggtgtgactgcctaccagacaccagatcttgcaagaccgccaataaaagtcttgcttccgctgttcttcatgtctccaagtccattctttgggtttggatgagtaaatgagtgtttctcacaggcgtgaaccaacatcccaccagaacgttattggtagtaacccgtcatggtttctttgagccccaggaacaattattatagcctagaatttcagatgacaacaaatcacagctccatacatacggctgcacacatacagcccctcagggcatattttccttatggactgtacccctagttcagttttaagcaatctggagactgctccaacattcactagagagttaaagactaacgtgttgaaattttg

SEQ ID NO: 344300 - DNA, 913 bp, Homo sapiens
agagtctcactctgccacccaggttgaagtgctgtgatgcgatcatagctcactgtagcctcaatctcccaggctcaagtgatcctccagcatcagccttttgagtagctgggactgcaggatgaacctaaccagttggcagtgcctcgtactctgtgatggattttccgaagaccaaatgtaccattttcttgtcttttcaaagagagccacacaggaaggaaaacaagaaattcaacttttaagctgggctattcatggcctttgctaaatcctggcagaatttcacagttcttcattacaattcatctcactgatttcctaatgcaatgaactggccttttcattaaggccatagggaatgaagctgagttacccaatcattaagtgttgttatctgatgagtgaaaaatggattacttttcaatgtgcatttggggagccgtgtgtgtgtgtgtgttgtgtttccactagattccattttgcgaaaattggttcaagtggaaggagaaggttaatctttcatgttctgttctgctagaacactatatggctttctgctctgtgagcaggcaaagaaaaattggtgggctcaggaatcagaaatgcagggccaacagtcctgtttctcactttcgataaaggccaacattttacctgctcaagaacactctattcctttaaccaacgggagtgttatttaattagttccttagtttttcagctaaagcagacacatgcgcacatcacacacacatgcatgcgctgtggtgttttttcttctatcacccctccctccacagagatatcaatttgcataagaggagaaaataaattcatttaaaccccattctaaattcagtattagaaatgtaatgatctctaacactgacctttttaaaatactttgtgg

SEQ ID NO: 344301 - DNA, 893 bp, Homo sapiens
agagatgagaagatgggaacctagaaggagatgtgagcagcccaaggtcaccagctcacgtggagcagtgctagggcttgagcagagctctgctgctgattctgggcttctgtgaagagtgattcatgctcagtgagcctgtaaatatgatcttacctgaacaagagagtttttctcatgacccacgaggaaacacttccttgttactcacagtagagacctggttagaaagtgctggagagggctaggtgtggtggctcacgcctgtaatcccagcattttaggaggctgaggtgggcagatcatttgaggtcaggagttcgagaccagcctgggcaatgtggtgaaagtgaaaacccatctctgctaacaatacaaacattagccaggcgtggtagcacgcacctgtaatcccagctactcgagaggctgtggcaggagaattgtgaacctgggatgcagagtttgtagtgagctaagatagccccagtgcactccagcctgggcgacagagcaagactgtttcaaaaaaaaaaaagaaagtgccagaaagataagcatatacaagaaccacttacctttgcttggggctgcactgtggccccagttgctgggagaggcttctgtgaaggccgttgatagctgcaggcagtgacattctcaggggcccctagcagacaactcatccgggctcagggacacacctgggagccagtggcaggaatgtggagacactgcttggtggtggccaagcagcccagcctcgtagctgctgcctgtcacttctgagaatgtaagaaactgtgccctggtgtgtgatgttccccttcctgtatacctatgtaactaacctgcacattgtgcacatatatcctaaaacttaaagtataatt

SEQ ID NO: 344302 - DNA, 87 bp, Homo sapiens
acttcctgttttggattacagattgaatgttttggaccacctgttttaagtggcaggtgtctgtggtcaaacctactttggttaatg

SEQ ID NO: 344303 - DNA, 449 bp, Homo sapiens
gttgttctagaacagcacagtttttctagaaatcaagagaataaaaatttacacgtgcccatagtcttagctactctggatgtctgaggtgggaggatggctgagcccagtagttagagaccagcttgggcagcatagcaagactctgtctcaaaacattttttttttgaaaaaggaaatagaggtttatgtagaaaatattccaagtctgaattatgtaatggttctccatggacatgctacatgcgtatagcagggatccctgaacaaatgttcatggacctgtttttatattcccttcgtaatgggattgggaagggaaaggccttgcctctcatccccattagaagccagtctcatcctacgtgatcagtctctgctgcccttgctcagaccacttgtagttgcctcccttttcctctgtcaaccctgggccctcactgctgctc

SEQ ID NO: 344304 - DNA, 488 bp, Homo sapiens
agcgaacttcgaagaaaacgagaggagttagaggaagctccggtttcttcccacagttttgattcatcaaacgtgaggaagcctttggaaaccgggcaccgttgttccagctcctcttccctccctgtcatccatgacccttctgtgtttctcctcggtccccaactctaccttccccaaccacagttcctgtccccagatgtcctgatgcccaccatggcaggggagcccaatagactcccaggaacttcaaggagtgtccagcagtttctggctatgtgtgacaggggtgaaacttcccaaggggccaagtacacaggaaggactttgaactaccagagcctcccccatcgctccagaacagacaactcctgggcaccctggtcagagaccaaccagcatattgggaccagattcctgactactccagggtgcaatcctcaactaacctacactgccacactaccagaaagaagcaagggccttca

SEQ ID NO: 344305 - DNA, 557 bp, Homo sapiens
acactcaaagtccactgcctccatgaccagtgcatctccaggtttgcctaaggaatatagtccttgtgacctgactgtcactcatatgtattcagggccccaggccactttggtcagctggtggcagaaccagctgggactcaggtctgtcccactctacctgaggattctcctctggcccagagctgatctaaatgtgtcctctgtgggtgccagcagaattctgctcagtgtagtgctgtgctgtgacagggcagcagtgagttccaatgcaaaatcccacactcctctcgctccaccacatgcacagattctctctccaagctgttgtgccagaggtgagggaggggggcataggcgatgcaggaccgtctttcccaccctcttcagtgcctcttcttgatacgatgtgaaaaccaggtactgtgatcactcacctgattttttgtttcttatgaagatgctttttttttttttttaaataaggagtctcactctgtcacccaggctggagcgcagtggcaccatttcgtctcactgcaacctctgcttcccag

SEQ ID NO: 344306 - DNA, 402 bp, Homo sapiens
cactgtcccagtcctcatggcatttatagatgagcctgtgtgtgttttatttcattataccaacctttgtctatatgcctaagctctctatgccttggtttcagtccctagacaaaaggctaacatattaggaattctgttttgcacccttcacaaaaaggtagctaaacatgaaacatttggttaatcaaaattaagtcattcatatgtataggtctccctgcccatattcctgtgttacctggtgatagccttttgcccagcagacaggtgagcatggtcatcttaatgccacagtaaaaaaagcctctctactactcctaacttgatgatcacaaagcaggccctattatagtatgttcttcccgctcccccctcgccccccgagatggagtcttgctg

SEQ ID NO: 344307 - DNA, 403 bp, Homo sapiens
ggttgtttccttttatttattttcagaggcagggtctcactctgtcatccaggatgaagtgctgaagtgcagtggtgcactcccagctcaccgtaaactcgaactcctaggctcaaggggatcctcccactttggcctctcaaagtgctggattacactgcgcatggcctatagcagttagtcgacccttaaattacactagcaatgtcattggcagcctcctgattccctcccaaagtgctgggattacaggcgtgagccacagcacccggcctgtccttttccttttattcagttgtattaaatatatatatggttttttttttttcttttttgagaaggagtctcgctgttgcccagactggaatacagtggcacaatctcggtttactgcaaccccgag

SEQ ID NO: 344308 - DNA, 461 bp, Homo sapiens
ttttactgtgtaccagcactgagtcaggcgaactgaagacttcaacctcggtttcaaccggtagtctgtcataggatttacagattcatgtaacgctcttgacagggatggttatagtttttacctggcttaaaggggggcgggggttccctttttttaaaatcaatttcaatcttatttggaagctcagtgtatcaaacacattcaaaatagaggtgctttgcttaggaaagagcatggcttgtttgggatcccccatccttatcctgcctctgactgcctctggaaacctttgccctaaataatgatggtctgctttctaaggctattgggtgagagaccaacttggaatgcttaataagcaagcatggaagtaacttgcagaagaaaaaagacttcagccttttaatgtcaaaaatatcaaatagggaataatttcaagtggtgatgtcagggacagc

SEQ ID NO: 344309 - DNA, 633 bp, Homo sapiens
cgctcccccccgatctctatttaaaaaaaaaagaaaagaaaaaagaaaaattagtccagaagttccaggctgcagtgagctatgatcataccactgtactccagcctgggtaatggagcaagaccctgtctctaaaaaaataagaaaaatataaaaataaaacacgtcttattaggcagggtgtttaataatttttaaaaacaaggataacagactggccgcagtggctcacacctgtaatcccagcactttggaaggctgaggcagatggactgtttgagtccaggagtctaagaccagcctgggcaacatggcaaaaccccatctctacaaaaaatacaaaaaatagctgggctggtcgcagtggctcacgcctgtaatcccagcactttgggaggccaagacaagtggatcacgaggtcaggagtttgagaccagcctgaccaacatggtgaaacccccgtctctactaaaaatacaaaaattagccaggcatggtggttgcatgcctgtaatcccagctactcaggaggcagaggcaggagaatcacttgaacccgggaggcagaggttgcagtgagccgagatcacgccaccgcactccagcctaggtgacagagtgagactccatct

SEQ ID NO: 344310 - DNA, 857 bp, Homo sapiens
tggtgaacgggtgatggggttggtgactctggatggtgatggtgatggggctggtgactttggatggtgatagtgaagggctgggtgactctggatggtgatggtgatgggtctgggtgactttgctagtgatggtgatgggctgggtgactgcggatggtgcttaaggcaggtggctgggctggcacctagcggataagcagaagctggttctgcagagctgggaaggcaggatcctgtgggctgggcatggtgcgggcgtgggtacaggggtaagttggagaagttggtgaggcataagttggcagggcccagattgggaggccaccatggagaagaaggtgtcttaccaggttgaacctggcagccgtgtgggagaggcaggctggaggcagggaggtcagagctcagtgaggcctggacctaacagtggcagagggaatggaagaaggcacaaaggagacgggggtgcaggaggcgcaggcaccagcctgggggacaaatacagccacatctcagcacgtgccgcccccagccacgatcagtttgtcatgagagaggagagtctattctctcctcttcaccatgtctatgcctatatccacacccacgatcatagatagagcatctgaagctctttctacgtccagagccacattatctagatcacatccacatcgctgtctagatccgtttccacatcgctgtctagatccgtttccacatcacccgtacccggttagatccacaccctatgcatctatctatatcctcatccgcgtctaacttcctcttctccacctgtgtcctcatccgcgtctaaccccatcttctccacctgtatcctcatccgcgtc

SEQ ID NO: 344311 - DNA, 507 bp, Homo sapiens
  misc_feature (14)..(14): n is a, c, g, or t
  misc_feature (16)..(17): n is a, c, g, or t
ctactactactaantnngcggccggtcgacgtcacccaccccgataccatcaccatccaaagtcacccagacctatcaccatcatcatccagagtcaccagccccttcaccatcaccatccaaagtcaccagcccctttaccatcaccatccgcgtctacctccatcttctccacctgtatcctcatccgcgtctacctccatcttctccacctgtatcctcacccgcgtctacctccatcttctccacctgtatcctcacccgcgtctacctccatcttctccatctgtatcctcatccgcgtctgtctccaccttcttcacctgtatcctcatccgcgtgtgtctccatcttcttcacctgtatcctcatccgcgtgtgtctccatcttcttcgcctgtatcctcatccgcgtgtgtctccatcttcttcgcctgtatcctcaactgcgtgtgtctccatcttctccatctccactgctcccctgtccacgtccactgccatgtc

SEQ ID NO: 344312 - DNA, 422 bp, Homo sapiens
ttcaggatccatgtcttctgcttgcttgtttgttgtatttcctagaggaaaacagtctggtgttaaccttgggttttactggctacctcaccccatagaaacacaacaataacaacgaatgcttctttgaacaccatttttcactattctaagcattttatatgcattaattatcagttacatttgctgttaggcaaatgctaccacatcctctttttacagataatgaggcagacagagaggttatgtgactcacttggggccgcccagctggttagtgacgggcccagagcaccctccagagacactgtcctgaaccatcgtgctgtgctgccacccactgagcttggagcaccacggggagggggtggggaaaggcgaaacgtcaggagagggtgagaaatgggaatttggaggcataa

SEQ ID NO: 344313 - DNA, 850 bp, Homo sapiens
gatctcgagtagtccagtgaccaatactgatatatgctctttaaggatcatggatatcctgcattcctgaagagctttcatttggtaggacttggtgcaaccctgtgtgctataaacatcactgaaatcccacttataaagatctcagaattcagggtggtagtggccagaattgggaccctgctctgcagcacacatgtcttagccgagtttaagaggaaggctgaagttgtgtttggggatcccactgagtggaccagttctgtcttgcaggagcttgggaccattgcagctggattaactaaggcagagctccggatgcttgacaaggatttgatgccatatttccagccatcagcaataaaatgccttcctgatgagatattcaaagagctgtccgcggagcagatcgcctccctgggtccggagaacgccgcggcggtgacccacgcccagcgccggcggctcagtccactgcagctgcagagcctccagcaggcgctagatggcgccaagactcactcctggcaggacgcgcccgctagcgccggtcccactagaacctcatcctcgcgttctcccgcaggagctctccagtcgtggggtctttggcttggttgtcccctgctggttctaatggccaagctcctgtggtgagtggcctgagcgcatcgtcctgtgttgccccaagcagctggccaacatgtgtagagacaggatgctccagatggtgggacacccttccctggatccagaccctcatctagggcagggaaaccctggggccttgatggtgaaaatgcaccccaaatgaaaaataattattaaaaatgatcttgcaaattaaaat

SEQ ID NO: 344314 - DNA, 891 bp, Homo sapiens
tttctcttccccccaccatcagcggcgactaacgacaaaaacaaccaactcaggctgaatccttttgcaaggtgtacctggatgattcaggatacagtatccaggacctgaagagctttcatttggtaggacttggtgcaaccctgtgtgctataaacatcactgaaatcccacttataaagatctcagaattcagggtggtagtggccagaattgggaccctgctctgcagcacacatgtcttagccgagtttaagaggaaggctgaagttgtgtttggggatcccactgagtggaccagttctgtcttgcaggagcttgggaccattgcagctggattaactaaggcagagctccggatgcttgacaaggatttgatgccatatttccagccatcagcaataaaatgccttcctgatgagatattcaaagagctgtccgcggagcagatcgcctccctgggtccggagaacgccgcggcggtgacccacgcccagcgccggcggctcagtccactgcagctgcagagcctccagcaggcgctagatggcgccaagactcactcctggcaggacgcgcccgctagcgccggtcccactagaacctcatcctcgcgttctcccgcaggagctctccagtcgtggggtctttggcttggttgtcccctgctggttctaatggccaagctcctgtggtgagtggcctgagcgcatcgtcctgtgttgccccaagcagctggccaacatgtgtagagacaggatgctccagatggtgggacacccttccctggatccagaccctcatctagggcagggaaaccctggggccttgatggtgaaaatgcaccccaaatgaaaaataattattaaaaatgatcttgcaaattaaaat

SEQ ID NO: 344315 - DNA, 296 bp, Homo sapiens
cttgtgtatgtcgtgcatagaatctagctgctttcctctattgagcgcagagtatactatgtctctatgtgaatatggacagttagcatttaccaacatctccttgtctactgtgtcttttttttttggaaatggagtctcgctctttcgcccaggtgggagtgcagtgccgtgatctcggctcactgcaagctccgcctccggggttcatgccattctccggcctcagcctcccaagtagctggaactacaggtgccgtgccaccacgcccggcataattttttttttttttttt

SEQ ID NO: 344316 - DNA, 279 bp, Homo sapiens
tcaatccaatatgatacaatgtacttttccttgtcatagacttcactcaacattggtctccaagtatgtacccttctacggtggtatagaaaaaggaaaaacttgtccaaacagggcagagacagtaggagatgatttggacaggaactgtagctgtttgaagagagataagtttgtgtaatcaagggaaaggagacagttgactgagatttaaaagatgtttataattttaaatgtctttttaccctctagcagttggtctctatttaagcagaattt

SEQ ID NO: 344317 - DNA, 421 bp, Homo sapiens
  misc_feature (58)..(58): n is a, c, g, or t
tggtagccacatcagcacacgagaaaaaactcctatgtgacttggctgcttcttaggngacctggttgcttcctctcgtggtcattgtgaacgctgctgcaatgaacatggtggtacaaatatctcttagagaccctgcttttcaatgctttgggatacatacccagacatgggattactggataataggcctgccattcccatatcctgcgcccataaaaggaccagctgacagagcaatatgaatggctaagtgttggggatacaagaagagactacagatagctgcggccaacttcagatggtgcgacttcagggaaagatcaccttcttcccccaccatcccctttcctattccccattccactgagagccacatccattgcccaataaaatcctccacatatactacccttcaaag

SEQ ID NO: 344318 - DNA, 360 bp, Homo sapiens
ttcctgacctcgggagatccacccaccttggcctcccaaagtgctgggattacaggcgtgagccatcatgcccagctaccatcgttctactttctgttactatgagcttgactacttcagatacattatcctgccattcccatatcctgcgcccataaaaggaccagctgacagagcaatatgaatggctaagtgttggggatacaagaagagactacagatagctgcggccaacttcagatggtgcgacttcagggaaagatcaccttcttcccccaccatcccctttcctattccccattccactgagagccacatccattgcccaataaaatcctccacatatactacccttcaaag

SEQ ID NO: 344319 - DNA, 597 bp, Homo sapiens
acactaacggcgtccgaaccgacccaggggcctgctgggcccccaccttcgtccccaacgctcctcagaggtggctccagcctcgctagcgaccccctcacccccagggaagaaacacattctggtgcttagcgagctgcgcgccgaggacgccggtgaagtccgcttccaggcggggcccgcccagtccctggctctactggaagtggaggcattgcctctccagatgtgccgccacccccctcgcgagaagaccgttctggtgggccgccgggcggtgctggaggtgactgtgtcccgctcggggggccacgtgtgctggctgcgggagggggccgagctgtgcccgggagataagtatgagatgcgcagccacggccccacccacagcctggtcatccatgacgttcgacctgaggaccaaggcacttactgctgccaggccggccaggacagcacccacacacggctgctggtagagggcaactaggagaacctaaccaggccaggcgggtgcccttggacagcttggaaggcgtttgcccttaccctgggcaggggtagagagacaaggaacaataaaagtgctacagctca

SEQ ID NO: 344320 - DNA, 233 bp, Homo sapiens
ggctgggaagagaggctcctaagagcaggaagccaggcagcgggcaggggaggctgcggggccactcgctggagaggcaaacaggaaggactgccccctgagcgccaggcttcgggcccgggaatcgccgccgccgccgccgcagagctgcagctcggggccgagggtaaggaggcgagccgggagcgggaggcccgggagagctccgcgggtccccgcgcccagtccccagc

SEQ ID NO: 344321 - DNA, 259 bp, Homo sapiens
ctgggttcaagcaatccttctgcctcagcctccctagtaactaccatgcccggcattccagcctgggtgacagcaagaccctgtctcaaattttaaaaatggggttgatccccgtctcaagtgtctctgggaacattaactgagataacatgaaaattcttacacagagcttggtgaatggttgtcattggtgacacatctcttctaacttatttcattcaagaaatcatcacaataaacctgtgtcccaatgttaaaa

SEQ ID NO: 344322 - DNA, 3057 bp, Homo sapiens
gccccgggcctcggctcgcctctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctctactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagagtcttaccaaagtcaggacagttcaaataacaatccggagttatgcgtcctcttgaaaaagccgaagacccggcggctctggtcccgcttccccccatggcgacgaacagctggcactgagtagcagctgcccccatagtttggggcccacattcctctgtcccacctccctgccattgctttttgcctctccccagactgcttcagccgctaacctaacctggcccctgtgggcatttgagtttgcgacccctgtgttaaaccaataaacatgcaaataaatgtacagtgacacctggtgataagtactgt

SEQ ID NO: 344323 - DNA, 3486 bp, Homo sapiens
gccccgggcctcggctcgcctctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctctactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgagggcaggaaggcctctggacaggcgaggcagggcaggaggttggccagatgccggagctgggttggtgaagtagatttaaggtggaagggctgtggaggcccaagcaaggccggaacacatccctgccttggtctcaggtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagagtcttaccaaagtcaggacagttcaaataacaatccggagttatgcgtcctcttgaaaaagccgaagacccggcggctctggtcccgcttccccccatggcgacgaacagctggcactgagtagcagctgcccccatagtttggggcccacattcctctgtcccacctccctgccattgctttttgcctctccccagactgcttcagccgctaacctaacctggcccctgtgggcatttgagtttgcgacccctgtgttaaaccaataaacatgcaaataaatgtacagtgacacctggtgataagtactgt

SEQ ID NO: 344324 - DNA, 5284 bp, Homo sapiens
  misc_feature (4600)..(4600): n is a, c, g, or t
gccccgggcctcggctcgcctctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctctactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagccccaccagagaggattgtgcacccggcagcccgctccctggatctgcattttggggctccagggcgcgtggagctgcgctgtgaggtggccccagctgggtctcaggtgcgctggtacaaggacgggctggaagtggaggcatcagatgccctgcagctgggtgccgaggggcccacccgcaccctgaccctgccccacgcccagcctgaggacgccggggagtatgtgtgtgagacccggcatgaggccatcaccttcaatgtcatcctggctgagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccactgctggtgaagctggtctcggacctgacaccactcactgtccacgagggcgatgatgccacgttccggtgtgaagtctccccaccagatgccgatgtcacctggctgcgcaatggggccgtcgtcactccagggccccaggtggagatggcccagaatggttcaagccgcatcttaaccttgcgaggctgccaactgggggatgcagggaccgtgactttgcgggcagggagcacggccacaagtgcccggctccatgttcgagagacagagctgctgttcctacggcggttgcaggatgtgcgggcagaggaaggccaggacgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggcgtgagtgccccgtcctctcttaatgcattacccaccctacaccacagccttttctggctgtcctggagtccctcaggcccccaccaaagtgcccctcatcgctgagaaaagtcacccatggccgtcccagcagcagcttgcccaaagcaaaacttttctttttctaatattttttatttaccttagaantccatgtggattttgcattccattgcatatttccaagtcggctttgctataaacacaaatattctccagaaagacttgccatgggcatccttcaggcatgtattctagggatacacatacccacttaagtagcagggatggctgtcaaacagcaccccacacctcccacccaaagctggagccctctgtttcctatgtgacctcatgcaagttaacctctttgagccaagtctccttaaaaatggggctgagaccaggtgcagtggctcacgcctataatcctaacactttgggaggccaaggcaggaggatcccttgaggccaggagttcgaggccatcctgggcaacatagcaagaacccatctccacaaaaaaaataaaaattagccgggcatggtagttactagggaggctgaggcagaaggattgcttgaacccaggaggttgaggctatagtgagctatgatcatgtcacggcattccagcctgggtgacagcaagaccctgtctcaaattttaaaaatggggttgatccccgtctcaagtgtctctgggaacattaactgagataacatgaaaattcttacacagagcttggtgaatggttgtcattggtgacacatctcttctaacttatttcattcaagaaatcatcacaataaacctgtgtcccaatgttaaaa

SEQ ID NO: 344325 - DNA, 5952 bp, Homo sapiens
gccccgggcctcggctcgcctctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctctactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccccctgtgcgggtggtagctcccgaggcagcccagacgagggttcggagcaccccaggcggggacctagagctggtggtgcacctctccgggccagggggccctgtacgctggtacaaggacggggagcgactggcaagccaggggcgggtgcagctggagcaggccggggccaggcaggtgctgcgggtgcagggggcacggagcggggacgctggggagtacctgtgcgatgcgccccaggacagccgcatcttccttgtcagcgtggaagagccactgctggtgaagctggtctcggacctgacaccactcactgtccacgagggcgatgatgccacgttccggtgtgaagtctccccaccagatgccgatgtcacctggctgcgcaatggggccgtcgtcactccagggccccagagacagagctgctgttcctacggcggttgcaggatgtgcgggcagaggaaggccaggacgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggcgacgggaacgcgcttacgcctagcccgcggctccggctccaggccctcggcacgcgccgccttctccagctgcgacgctgcggcccctcggacgccgggacctacagctgcgcggtggggacggcccgcgccggaccggtccgcctgaccgtgcgcggtgggtacggggtgatgtggaggctgggcactgctttgggcgcgagacttgcggagctgtcttccccggaccctgatgaccgcgcgtgcttctagaaagggggcgtggagggggcgtgaccggtaactgccctctgccccgccccgctcacgccccgggctccgccccagagcgtactgtggcggtactctccgagctgcggtcggtgagcgcccgcgaaggcgacggcgctacgttcgagtgcaccgtgtcggaggtcgagaccacggggcgctgggagctcggaggccgcccgctgagacccggagcccgcgtccgcatccaacaggaagggaagaaacacattctggtgcttagcgagctgcgcgccgaggacgccggtgaagtccgcttccaggcggggcccgcccagtccctggctctactggaagtggaggcattgcctctccagatgtgccgccacccccctcgcgagaagaccgttctggtgggccgccgggcggtgctggaggtgactgtgtcccgctcggggggccacgtgtgctggctgcgggagggggccgagctgtgcccgggagataagtatgagatgcgcagccacggccccacccacagcctggtcatccatgacgttcgacctgaggaccaaggcacttactgctgccaggccggccaggacagcacccacacacggctgctggtagagggtgagtaaagccaactgggcagcggcaggagggtgagggcgcctgggagctgatgggttaagccacacctatgggaggctttccaggacttggggtggcaacgggtcctgggatacgtaggaggtggggatgggggaggggaggggtagagcacacccagggctggaaagccctggaactgcttggctcagatcagctgctcctggtcagctgttcccacctttctacgccccttcttgccaggcttctcctctctcctgccactggaccatgtttgtctctcttgaacagccctgtttctaccagttcctttcctccccacttcaccaacactgccttcctccagcctgtccctcctccttcctgccctctgcccagcttgcctctgcccatctcagcaagttccatgtcagcctcggcagaagcctctttctttcctcttccccataagagacatcccaccttctatcccaaatcccagcattcccttcaggtgccacgctgtgccccacccctagctgacccccaccttcctgccgccaagacagccctaaccaaggcccagaaagggtagggcagaacctgggggcccagctctttgtgtactggtgtccaggctctgccaggggagaggaaggtggtacccccttctctccccagccccatgtggagtcattcctctgcaggcaactaggagaacctaaccaggccaggcgggtgcccttggacagcttggaaggcgtttgcccttaccctgggcaggggtagagagacaaggaacaataaaagtgctacagctca

SEQ ID NO: 344326 - DNA, 5120 bp, Homo sapiens
gccccgggcctcggctcgcctctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctctactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagccccaccagagaggattgtgcacccggcagcccgctccctggatctgcattttggggctccagggcgcgtggagctgcgctgtgaggtggccccagctgggtctcaggtgcgctggtacaaggacgggctggaagtggaggcatcagatgccctgcagctgggtgccgaggggcccacccgcaccctgaccctgccccacgcccagcctgaggacgccggggagtatgtgtgtgagacccggcatgaggccatcaccttcaatgtcatcctggctgagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagacagagctgctgttcctacggcggttgcaggatgtgcgggcagaggaaggccaggacgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggcgacgggaacgcgcttacgcctagcccgcggctccggctccaggccctcggcacgcgccgccttctccagctgcgacgctgcggcccctcggacgccgggacctacagctgcgcggtggggacggcccgcgccggaccggtccgcctgaccgtgcgcggtgggtacggggtgatgtggaggctgggcactgctttgggcgcgagacttgcggagctgtcttccccggaccctgatgaccgcgcgtgcttctagaaagggggcgtggagggggcgtgaccggtaactgccctctgccccgccccgctcacgccccgggctccgccccagagcgtactgtggcggtactctccgagctgcggtcggtgagcgcccgcgaaggcgacggcgctacgttcgagtgcaccgtgtcggaggtcgagaccacggggcgctgggagctcggaggccgcccgctgagacccggagcccgcgtccgcatccaacaggaagggaagaaacacattctggtgcttagcgagctgcgcgccgaggacgccggtgaagtccgcttccaggcggggcccgcccagtccctggctctactggaagtggaggcattgcctctccagatgtgccgccacccccctcgcgagaagaccgttctggtgggccgccgggcggtgctggaggtgactgtgtcccgctcggggggccacgtgtgctggctgcgggagggggccgagctgtgcccgggagataagtatgagatgcgcagccacggccccacccacagcctggtcatccatgacgttcgacctgaggaccaaggcacttactgctgccaggccggccaggacagcacccacacacggctgctggtagagggcaactaggagaacctaaccaggccaggcgggtgcccttggacagcttggaaggcgtttgcccttaccctgggcaggggtagagagacaaggaacaataaaagtgctacagctca

SEQ ID NO: 344327 - DNA, 5363 bp, Homo sapiens
gccccgggcctcggctcgcctctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctctactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccccctgtgcgggtggtagctcccgaggcagcccagacgagggttcggagcaccccaggcggggacctagagctggtggtgcacctctccgggccagggggccctgtacgctggtacaaggacggggagcgactggcaagccaggggcgggtgcagctggagcaggccggggccaggcaggtgctgcgggtgcagggggcacggagcggggacgctggggagtacctgtgcgatgcgccccaggacagccgcatcttccttgtcagcgtggaagagccactgctggtgaagctggtctcggacctgacaccactcactgtccacgagggcgatgatgccacgttccggtgtgaagtctccccaccagatgccgatgtcacctggctgcgcaatggggccgtcgtcactccagggccccaggtggagatggcccagaatggttcaagccgcatcttaaccttgcgaggctgccaactgggggatgcagggaccgtgactttgcgggcagggagcacggccacaagtgcccggctccatgttcgagagacagagctgctgttcctacggcggttgcaggatgtgcgggcagaggaaggccaggacgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggcgacgggaacgcgcttacgcctagcccgcggctccggctccaggccctcggcacgcgccgccttctccagctgcgacgctgcggcccctcggacgccgggacctacagctgcgcggtggggacggcccgcgccggaccggtccgcctgaccgtgcgcggtgggtacggggtgatgtggaggctgggcactgctttgggcgcgagacttgcggagctgtcttccccggaccctgatgaccgcgcgtgcttctagaaagggggcgtggagggggcgtgaccggtaactgccctctgccccgccccgctcacgccccgggctccgccccagagcgtactgtggcggtactctccgagctgcggtcggtgagcgcccgcgaaggcgacggcgctacgttcgagtgcaccgtgtcggaggtcgagaccacggggcgctgggagctcggaggccgcccgctgagacccggagcccgcgtccgcatccaacaggaagggaagaaacacattctggtgcttagcgagctgcgcgccgaggacgccggtgaagtccgcttccaggcggggcccgcccagtccctggctctactggaagtggaggcattgcctctccagatgtgccgccacccccctcgcgagaagaccgttctggtgggccgccgggcggtgctggaggtgactgtgtcccgctcggggggccacgtgtgctggctgcgggagggggccgagctgtgcccgggagataagtatgagatgcgcagccacggccccacccacagcctggtcatccatgacgttcgacctgaggaccaaggcacttactgctgccaggccggccaggacagcacccacacacggctgctggtagagggcaactaggagaacctaaccaggccaggcgggtgcccttggacagcttggaaggcgtttgcccttaccctgggcaggggtagagagacaaggaacaataaaagtgctacagctca

SEQ ID NO: 344328 - DNA, 4946 bp, Homo sapiens
  misc_feature (4876)..(4876): n is a, c, g, or t
gccccgggcctcggctcgcctctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctctactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagccccaccagagaggattgtgcacccggcagcccgctccctggatctgcattttggggctccagggcgcgtggagctgcgctgtgaggtggccccagctgggtctcaggtgcgctggtacaaggacgggctggaagtggaggcatcagatgccctgcagctgggtgccgaggggcccacccgcaccctgaccctgccccacgcccagcctgaggacgccggggagtatgtgtgtgagacccggcatgaggccatcaccttcaatgtcatcctggctgagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccccctgtgcgggtggtagctcccgaggcagcccagacgagggttcggagcaccccaggcggggacctagagctggtggtgcacctctccgggccagggggccctgtacgctggtacaaggacggggagcgactggcaagccaggggcgggtgcagctggagcaggccggggccaggcaggtgctgcgggtgcagggggcacggagcggggacgctggggagtacctgtgcgatgcgccccaggacagccgcatcttccttgtcagcgtggaagagccactgctggtgaagctggtctcggacctgacaccactcactgtccacgagggcgatgatgccacgttccggtgtgaagtctccccaccagatgccgatgtcacctggctgcgcaatggggccgtcgtcactccagggccccaggtggagatggcccagaatggttcaagccgcatcttaaccttgcgaggctgccaactgggggatgcagggaccgtgactttgcgggcagggagcacggccacaagtgcccggctccatgttcgagagacagagctgctgttcctacggcggttgcaggatgtgcgggcagaggaaggccaggacgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggcgtgagtgccccgtcctctcttaatgcattacccaccctacaccacagccttttctggctgtcctggagtccctcaggcccccaccaaagtgcccctcatcgctgagaaaagtcacccatggccgtcccagcagcagcttgcccaaagcaaaacttttctttttctaatattttttatttaccttagaantccatgtggattttgcattccattgcatatttccaagtcggctttgctataaacacaaatattctccaga

SEQ ID NO: 344329 - DNA, 5692 bp, Homo sapiens
gccccgggcctcggctcgcctctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctctactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagccccaccagagaggattgtgcacccggcagcccgctccctggatctgcattttggggctccagggcgcgtggagctgcgctgtgaggtggccccagctgggtctcaggtgcgctggtacaaggacgggctggaagtggaggcatcagatgccctgcagctgggtgccgaggggcccacccgcaccctgaccctgccccacgcccagcctgaggacgccggggagtatgtgtgtgagacccggcatgaggccatcaccttcaatgtcatcctggctgagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccccctgtgcgggtggtagctcccgaggcagcccagacgagggttcggagcaccccaggcggggacctagagctggtggtgcacctctccgggccagggggccctgtacgctggtacaaggacggggagcgactggcaagccaggggcgggtgcagctggagcaggccggggccaggcaggtgctgcgggtgcagggggcacggagcggggacgctggggagtacctgtgcgatgcgccccaggacagccgcatcttccttgtcagcgtggaagagccactgctggtgaagctggtctcggacctgacaccactcactgtccacgagggcgatgatgccacgttccggtgtgaagtctccccaccagatgccgatgtcacctggctgcgcaatggggccgtcgtcactccagggccccaggtggagatggcccagaatggttcaagccgcatcttaaccttgcgaggctgccaactgggggatgcagggaccgtgactttgcgggcagggagcacggccacaagtgcccggctccatgttcgagagacagagctgctgttcctacggcggttgcaggatgtgcgggcagaggaaggccaggacgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggcgacgggaacgcgcttacgcctagcccgcggctccggctccaggccctcggcacgcgccgccttctccagctgcgacgctgcggcccctcggacgccgggacctacagctgcgcggtggggacggcccgcgccggaccggtccgcctgaccgtgcgcggtgggtacggggtgatgtggaggctgggcactgctttgggcgcgagacttgcggagctgtcttccccggaccctgatgaccgcgcgtgcttctagaaagggggcgtggagggggcgtgaccggtaactgccctctgccccgccccgctcacgccccgggctccgccccagagcgtactgtggcggtactctccgagctgcggtcggtgagcgcccgcgaaggcgacggcgctacgttcgagtgcaccgtgtcggaggtcgagaccacggggcgctgggagctcggaggccgcccgctgagacccggagcccgcgtccgcatccaacaggaagggaagaaacacattctggtgcttagcgagctgcgcgccgaggacgccggtgaagtccgcttccaggcggggcccgcccagtccctggctctactggaagtggaggcattgcctctccagatgtgccgccacccccctcgcgagaagaccgttctggtgggccgccgggcggtgctggaggtgactgtgtcccgctcggggggccacgtgtgctggctgcgggagggggccgagctgtgcccgggagataagtatgagatgcgcagccacggccccacccacagcctggtcatccatgacgttcgacctgaggaccaaggcacttactgctgccaggccggccaggacagcacccacacacggctgctggtagaggccccatgtggagtcattcctctgcaggcaactaggagaacctaaccaggccaggcgggtgcccttggacagcttggaaggcgtttgcccttaccctgggcaggggtagagagacaaggaacaataaaagtgctacagctca

SEQ ID NO: 344330 - DNA, 4898 bp, Homo sapiens
gccccgggcctcggctcgcctctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctctactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagccccaccagagaggattgtgcacccggcagcccgctccctggatctgcattttggggctccagggcgcgtggagctgcgctgtgaggtggccccagctgggtctcaggtgcgctggtacaaggacgggctggaagtggaggcatcagatgccctgcagctgggtgccgaggggcccacccgcaccctgaccctgccccacgcccagcctgaggacgccggggagtatgtgtgtgagacccggcatgaggccatcaccttcaatgtcatcctggctgagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccccctgtgcgggtggtagctcccgaggcagcccagacgagggttcggagcaccccaggcggggacctagagctggtggtgcacctctccgggccagggggccctgtacgctggtacaaggacggggagcgactggcaagccaggggcgggtgcagctggagcaggccggggccaggcaggtgctgcgggtgcagggggcacggagcggggacgctggggagtacctgtgcgatgcgccccaggacagccgcatcttccttgtcagcgtggaagagccactgctggtgaagctggtctcggacctgacaccactcactgtccacgagggcgatgatgccacgttccggtgtgaagtctccccaccagatgccgatgtcacctggctgcgcaatggggccgtcgtcactccagggccccaggtggagatggcccagaatggttcaagccgcatcttaaccttgcgaggctgccaactgggggatgcagggaccgtgactttgcgggcagggagcacggccacaagtgcccggctccatgttcgagagacagagctgctgttcctacggcggttgcaggatgtgcgggcagaggaaggccaggacgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggccgaggcagctgagggtgctgcggcctctggaggacgtgaccatcagtgaggggggcagtgccaccttccagctggagctgtcccaggaaggtgtgaccggggagtgggcccggggtggagtacggctgtatccaggacccaagtgtcacatccactcggacggccaccgtcaccgactggtactcaatggcctgggcctggccgactcagg

SEQ ID NO: 344331 - DNA, 3652 bp, Homo sapiens
gccccgggcctcggctcgcctctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctctactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacaggtgggcagtctctgcagcacagagaggaggtagagaggtagggggctaagggacagacacccacctagccccacctcccccaccccatccccagccttccccttatccagcttcctcatgtttggccatcagaatcctgcttagccacatcaggtcaggaccagaggcctggtgggagggtgcccagcaattagaaccattcgttcattcatccattcgttcaatactcattgagcaactactatgtgcttggcactgttttagatgctggggatacagcagtgaaccaataagactaaacctcttgtcttcacagagtttaaactctggtgagggtggacagacaaa

SEQ ID NO: 344332 - DNA, 2574 bp, Homo sapiens
ctgtgcacctcttgagggtggtcagagtaactgattgaaaaaacacagggttcttaggacagtgcctggcacacagcagctgctccatggactgcagctggcactgttctcaagagctgtgctgccagtggggagggctgaggatctggcgggtgaggcaggagaggcctgctggccaagcctatgtgcccctctccatgcccacccaccagccccaccagagaggattgtgcacccggcagcccgctccctggatctgcattttggggctccagggcgcgtggagctgcgctgtgaggtggccccagctgggtctcaggtgcgctggtacaaggacgggctggaagtggaggcatcagatgccctgcagctgggtgccgaggggcccacccgcaccctgaccctgccccacgcccagcctgaggacgccggggagtatgtgtgtgagacccggcatgaggccatcaccttcaatgtcatcctggctgagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccccctgtgcgggtggtagctcccgaggcagcccagacgagggttcggagcaccccaggcggggacctagagctggtggtgcacctctccgggccagggggccctgtacgctggtacaaggacggggagcgactggcaagccaggggcgggtgcagctggagcaggccggggccaggcaggtgctgcgggtgcagggggcacggagcggggacgctggggagtacctgtgcgatgcgccccaggacagccgcatcttccttgtcagcgtggaagagccactgctggtgaagctggtctcggacctgacaccactcactgtccacgagggcgatgatgccacgttccggtgtgaagtctccccaccagatgccgatgtcacctggctgcgcaatggggccgtcgtcactccagggccccaggtggagatggcccagaatggttcaagccgcatcttaaccttgcgaggctgccaactgggggatgcagggaccgtgactttgcgggcagggagcacggccacaagtgcccggctccatgttcgagagacagagctgctgttcctacggcggttgcaggatgtgcgggcagaggaaggccaggacgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggcgacgggaacgcgcttacgcctagcccgcggctccggctccaggccctcggcacgcgccgccttctccagctgcgacgctgcggcccctcggacgccgggacctacagctgcgcggtggggacggcccgcgccggaccggtccgcctgaccgtgcgcggtgggtacggggtgatgtggaggctgggcactgctttgggcgcgagacttgcggagctgtcttccccggaccctgatgaccgcgcgtgcttctagaaagggggcgtggagggggcgtgaccggtaactgccctctgccccgccccgctcacgccccgggctccgccccagagcgtactgtggcggtactctccgagctgcggtcggtgagcgcccgcgaaggcgacggcgctacgttcgagtgcaccgtgtcggaggtcgagaccacggggcgctgggagctcggaggccgcccgctgagacccggagcccgcgtccgcatccaacaggaagggaagaaacacattctggtgcttagcgagctgcgcgccgaggacgccggtgaagtccgcttccaggcggggcccgcccagtccctggctctactggaagtggaggcattgcctctccagatgtgccgccacccccctcgcgagaagaccgttctggtgggccgccgggcggtgctggaggtgactgtgtcccgctcggggggccacgtgtgctggctgcgggagggggccgagctgtgcccgggagataagtatgagatgcgcagccacggccccacccacagcctggtcatccatgacgttcgacctgaggaccaaggcacttactgctgccaggccggccaggacagcacccacacacggctgctggtagagggcaactaggagaacctaaccaggccaggcgggtgcccttggacagcttggaaggcgtttgcccttaccctgggcaggggtagagagacaaggaacaataaaagtgctacagctca

SEQ ID NO: 344333 - DNA, 733 bp, Homo sapiens
ggtcggtcttcataggtcgcaggcagagctgaaacagatctaggccaaacttctcatctataaaatcaggaaattgaggcccaaggaggttgattgtttctcagagaaacagagctggttaatggtgaacccaggctttttgcataccagtttagtcataataagtagttggtttttgggaatatccttttcataaatgatagtataaaagctgactgctaatacaactttacagaaggggataatcataggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagagtcttaccaaagtcaggacagttcaaataacaatccggagttatgcgtcctcttgaaaaagccgaagacccggcggctctggtcccgcttccccccatggcgacgaacagctggcactgagtagcagctgcccccatagtttggggcccacattcctctgtcccacctccctgccattgctttttgcctctccccagactgcttcagccgctaacctaacctggcccctgtgggcatttgagtttgcgacccctgtgttaaaccaataaacatgcaaataaatgtacagtgacacctggtgataagtactgt

SEQ ID NO: 344334 - DNA, 1412 bp, Homo sapiens
ttaggtcctgatgaggatgagatactctgtgtcccgtgcctgtactcccaaccaggattccagcagccttgcctctccacctagggacagaccagtgggatggagcaaggggccagcctccaaccccaccagactccatggcctccttcttccccaccagagacagagctgctgttcctacggcggttgcaggatgtgcgggcagaggaaggccaggacgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggcgacgggaacgcgcttacgcctagcccgcggctccggctccaggccctcggcacgcgccgccttctccagctgcgacgctgcggcccctcggacgccgggacctacagctgcgcggtggggacggcccgcgccggaccggtccgcctgaccgtgcgcggtgggtacggggtgatgtggaggctgggcactgctttgggcgcgagacttgcggagctgtcttccccggaccctgatgaccgcgcgtgcttctagaaagggggcgtggagggggcgtgaccggtaactgccctctgccccgccccgctcacgccccgggctccgccccagagcgtactgtggcggtactctccgagctgcggtcggtgagcgcccgcgaaggcgacggcgctacgttcgagtgcaccgtgtcggaggtcgagaccacggggcgctgggagctcggaggccgcccgctgagacccggagcccgcgtccgcatccaacaggaagggaagaaacacattctggtgcttagcgagctgcgcgccgaggacgccggtgaagtccgcttccaggcggggcccgcccagtccctggctctactggaagtggaggcattgcctctccagatgtgccgccacccccctcgcgagaagaccgttctggtgggccgccgggcggtgctggaggtgactgtgtcccgctcggggggccacgtgtgctggctgcgggagggggccgagctgtgcccgggagataagtatgagatgcgcagccacggccccacccacagcctggtcatccatgacgttcgacctgaggaccaaggcacttactgctgccaggccggccaggacagcacccacacacggctgctggtagagggcaactaggagaacctaaccaggccaggcgggtgcccttggacagcttggaaggcgtttgcccttaccctgggcaggggtagagagacaaggaacaataaaagtgctacagctca

SEQ ID NO: 344335 - DNA, 338 bp, Homo sapiens
tttttagcaggctccctaggaattcttatgcacagccaaagcactgctcttaagggttggtgtggaagcctaagcctatttttaaaaaccccaacaacagcagttgttccctctgatgcatccgacactgagcccatgcaccggagggaggggtgcttatctgtacttctccccacacagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtg

SEQ ID NO: 344336 - DNA, 269 bp, Homo sapiens
cacacccctcatgcccggcagtggctgtccctgtcctccagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgt

SEQ ID NO: 344337 - DNA, 3344 bp, Homo sapiens
gccccgggcctcggctcgcctctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctctactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagagtcttaccaaagtcaggacagttcaaataacaatccggagttatgcgtcctcttgaaaaagccgaagacccggcggctctggtcccgcttccccccatggcgacgaacagctggcactgagtagcagctgcccccatagtttggggcccacattcctctgtcccacctccctgccattgctttttgcctctccccagactgcttcagccgctaacctaacctggcccctgtgggcatttgagtttgcgacccctgtgttaaaccaataaacatgcaaataaatgtacagtgacacctggtgataagtactgt

SEQ ID NO: 344338 - DNA, 724 bp, Homo sapiens
tattctcattattatgtgggtgatagggacttcatgctgccgaatggctccagagaggctgacggtgagcttgtgacaggctgtggttgtccccaccctgcagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacaggtgggcagtctctgcagcacagagaggaggtagagaggtagggggctaagggacagacacccacctagccccacctcccccaccccatccccagccttccccttatccagcttcctcatgtttggccatcagaatcctgcttagccacatcaggtcaggaccagaggcctggtgggagggtgcccagcaattagaaccattcgttcattcatccattcgttcaatactcattgagcaactactatgtgcttggcactgttttagatgctggggatacagcagtgaaccaataagactaaacctcttgtcttcacagagtttaaactctggtgagggtggacagacaaa

SEQ ID NO: 344339 - DNA, 2892 bp, Homo sapiens
ggctgggaagagaggctcctaagagcaggaagccaggcagcgggcaggggaggctgcggggccactcgctggagaggcaaacaggaaggactgccccctgagcgccaggcttcgggcccgggaatcgccgccgccgccgccgcagagctgcagctcggggccgaggccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctctactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagagtcttaccaaagtcaggacagttcaaataacaatccggagttatgcgtcctcttgaaaaagccgaagacccggcggctctggtcccgcttccccccatggcgacgaacagctggcactgagtagcagctgcccccatagtttggggcccacattcctctgtcccacctccctgccattgctttttgcctctccccagactgcttcagccgctaacctaacctggcccctgtgggcatttgagtttgcgacccctgtgttaaaccaataaacatgcaaataaatgtacagtgacacctggtgataagtactgt

SEQ ID NO: 344340 - DNA, 1829 bp, Homo sapiens
agacgggcacgtaacttataagtggtccttaacggtcacgcgatgggcgctggtgttgtgcgtaacttcttggcgaccgaaggggctacatacatctgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagagtcttaccaaagtcaggacagttcaaataacaatccggagttatgcgtcctcttgaaaaagccgaagacccggcggctctggtcccgcttccccccatggcgacgaacagctggcactgagtagcagctgcccccatagtttggggcccacattcctctgtcccacctccctgccattgctttttgcctctccccagactgcttcagccgctaacctaacctggcccctgtgggcatttgagtttgcgacccctgtgttaaaccaataaacatgcaaataaatgtacagtgacacctggtgataagtactgt

SEQ ID NO: 344341 - DNA, 5666 bp, Homo sapiens
gccccgggcctcggctcgcctctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctctactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagccccaccagagaggattgtgcacccggcagcccgctccctggatctgcattttggggctccagggcgcgtggagctgcgctgtgaggtggccccagctgggtctcaggtgcgctggtacaaggacgggctggaagtggaggcatcagatgccctgcagctgggtgccgaggggcccacccgcaccctgaccctgccccacgcccagcctgaggacgccggggagtatgtgtgtgagacccggcatgaggccatcaccttcaatgtcatcctggctgagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccccctgtgcgggtggtagctcccgaggcagcccagacgagggttcggagcaccccaggcggggacctagagctggtggtgcacctctccgggccagggggccctgtacgctggtacaaggacggggagcgactggcaagccaggggcgggtgcagctggagcaggccggggccaggcaggtgctgcgggtgcagggggcacggagcggggacgctggggagtacctgtgcgatgcgccccaggacagccgcatcttccttgtcagcgtggaagagccactgctggtgaagctggtctcggacctgacaccactcactgtccacgagggcgatgatgccacgttccggtgtgaagtctccccaccagatgccgatgtcacctggctgcgcaatggggccgtcgtcactccagggccccaggtggagatggcccagaatggttcaagccgcatcttaaccttgcgaggctgccaactgggggatgcagggaccgtgactttgcgggcagggagcacggccacaagtgcccggctccatgttcgagagacagagctgctgttcctacggcggttgcaggatgtgcgggcagaggaaggccaggacgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggcgacgggaacgcgcttacgcctagcccgcggctccggctccaggccctcggcacgcgccgccttctccagctgcgacgctgcggcccctcggacgccgggacctacagctgcgcggtggggacggcccgcgccggaccggtccgcctgaccgtgcgcggtgggtacggggtgatgtggaggctgggcactgctttgggcgcgagacttgcggagctgtcttccccggaccctgatgaccgcgcgtgcttctagaaagggggcgtggagggggcgtgaccggtaactgccctctgccccgccccgctcacgccccgggctccgccccagagcgtactgtggcggtactctccgagctgcggtcggtgagcgcccgcgaaggcgacggcgctacgttcgagtgcaccgtgtcggaggtcgagaccacggggcgctgggagctcggaggccgcccgctgagacccggagcccgcgtccgcatccaacaggaagggaagaaacacattctggtgcttagcgagctgcgcgccgaggacgccggtgaagtccgcttccaggcggggcccgcccagtccctggctctactggaagtggaggcattgcctctccagatgtgccgccacccccctcgcgagaagaccgttctggtgggccgccgggcggtgctggaggtgactgtgtcccgctcggggggccacgtgtgctggctgcgggagggggccgagctgtgcccgggagataagtatgagatgcgcagccacggccccacccacagcctggtcatccatgacgttcgacctgaggaccaaggcacttactgctgccaggccggccaggacagcacccacacacggctgctggtagagggcaactaggagaacctaaccaggccaggcgggtgcccttggacagcttggaaggcgtttgcccttaccctgggcaggggtagagagacaaggaacaataaaagtgctacagctca

SEQ ID NO: 344342 - DNA, 5087 bp, Homo sapiens
gccccgggcctcggctcgcctctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctctactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccactgctggtgaagctggtctcggacctgacaccactcactgtccacgagggcgatgatgccacgttccggtgtgaagtctccccaccagatgccgatgtcacctggctgcgcaatggggccgtcgtcactccagggccccaggtggagatggcccagaatggttcaagccgcatcttaaccttgcgaggctgccaactgggggatgcagggaccgtgactttgcgggcagggagcacggccacaagtgcccggctccatgttcgagagacagagctgctgttcctacggcggttgcaggatgtgcgggcagaggaaggccaggacgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggcgacgggaacgcgcttacgcctagcccgcggctccggctccaggccctcggcacgcgccgccttctccagctgcgacgctgcggcccctcggacgccgggacctacagctgcgcggtggggacggcccgcgccggaccggtccgcctgaccgtgcgcggtgggtacggggtgatgtggaggctgggcactgctttgggcgcgagacttgcggagctgtcttccccggaccctgatgaccgcgcgtgcttctagaaagggggcgtggagggggcgtgaccggtaactgccctctgccccgccccgctcacgccccgggctccgccccagagcgtactgtggcggtactctccgagctgcggtcggtgagcgcccgcgaaggcgacggcgctacgttcgagtgcaccgtgtcggaggtcgagaccacggggcgctgggagctcggaggccgcccgctgagacccggagcccgcgtccgcatccaacaggaagggaagaaacacattctggtgcttagcgagctgcgcgccgaggacgccggtgaagtccgcttccaggcggggcccgcccagtccctggctctactggaagtggaggcattgcctctccagatgtgccgccacccccctcgcgagaagaccgttctggtgggccgccgggcggtgctggaggtgactgtgtcccgctcggggggccacgtgtgctggctgcgggagggggccgagctgtgcccgggagataagtatgagatgcgcagccacggccccacccacagcctggtcatccatgacgttcgacctgaggaccaaggcacttactgctgccaggccggccaggacagcacccacacacggctgctggtagagggcaactaggagaacctaaccaggccaggcgggtgcccttggacagcttggaaggcgtttgcccttaccctgggcaggggtagagagacaaggaacaataaaagtgctacagctca

SEQ ID NO: 344343 - DNA, 3571 bp, Homo sapiens
gccccgggcctcggctcgcctctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctctactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacaaggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagagtcttaccaaagtcaggacagttcaaataacaatccggagttatgcgtcctcttgaaaaagccgaagacccggcggctctggtcccgcttccccccatggcgacgaacagctggcactgagtagcagctgcccccatagtttggggcccacatccggactggcccacgggacagtacaggatgtggaggatgggcacgggcagcagcgggacaccctacctcaaggagatgaacatccgcacctacctggtcatcgacccccgggaccccacggtggaggaggcagttcacactgccactggccaggtggggcccgccttggcctgtctgctgcccagaaactggcctgcattcagggagtcacggcacgtcatggccacattctcatgtgaatctatccatgaggcattgctcaagaatgtcaggcccaaccagcgagtggctcctttcactctggtcctcgctatgccttggggctggcccgactgccagacctgggggacacaagggctggccttgactccactacacatctactg

SEQ ID NO: 344344 - DNA, 2356 bp, Homo sapiens
  misc_feature (1672)..(1672): n is a, c, g, or t
tattctcattattatgtgggtgatagggacttcatgctgccgaatggctccagagaggctgacggtgagcttgtgacaggctgtggttgtccccaccctgcagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagccccaccagagaggattgtgcacccggcagcccgctccctggatctgcattttggggctccagggcgcgtggagctgcgctgtgaggtggccccagctgggtctcaggtgcgctggtacaaggacgggctggaagtggaggcatcagatgccctgcagctgggtgccgaggggcccacccgcaccctgaccctgccccacgcccagcctgaggacgccggggagtatgtgtgtgagacccggcatgaggccatcaccttcaatgtcatcctggctgagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccactgctggtgaagctggtctcggacctgacaccactcactgtccacgagggcgatgatgccacgttccggtgtgaagtctccccaccagatgccgatgtcacctggctgcgcaatggggccgtcgtcactccagggccccaggtggagatggcccagaatggttcaagccgcatcttaaccttgcgaggctgccaactgggggatgcagggaccgtgactttgcgggcagggagcacggccacaagtgcccggctccatgttcgagagacagagctgctgttcctacggcggttgcaggatgtgcgggcagaggaaggccaggacgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggcgtgagtgccccgtcctctcttaatgcattacccaccctacaccacagccttttctggctgtcctggagtccctcaggcccccaccaaagtgcccctcatcgctgagaaaagtcacccatggccgtcccagcagcagcttgcccaaagcaaaacttttctttttctaatattttttatttaccttagaantccatgtggattttgcattccattgcatatttccaagtcggctttgctataaacacaaatattctccagaaagacttgccatgggcatccttcaggcatgtattctagggatacacatacccacttaagtagcagggatggctgtcaaacagcaccccacacctcccacccaaagctggagccctctgtttcctatgtgacctcatgcaagttaacctctttgagccaagtctccttaaaaatggggctgagaccaggtgcagtggctcacgcctataatcctaacactttgggaggccaaggcaggaggatcccttgaggccaggagttcgaggccatcctgggcaacatagcaagaacccatctccacaaaaaaaataaaaattagccgggcatggtagttactagggaggctgaggcagaaggattgcttgaacccaggaggttgaggctatagtgagctatgatcatgtcacggcattccagcctgggtgacagcaagaccctgtctcaaattttaaaaatggggttgatccccgtctcaagtgtctctgggaacattaactgagataacatgaaaattcttacacagagcttggtgaatggttgtcattggtgacacatctcttctaacttatttcattcaagaaatcatcacaataaacctgtgtcccaatgttaaaa

SEQ ID NO: 344345 - DNA, 2022 bp, Homo sapiens
catgaccatcacttggataggggctcagggctcctctttccagaaaccctcatgttgagagcagcataaaccagtggttaaaagcaggggctctagagtccacccagccaggttccagcctagattctgtgccccagtagctgtgtgacattggccaagttgttcaacctgtctgagccccggctctgaaaagaggggatagtgcttttcttataggcctgttgtgacaagtaaatgctgtaaatagggtccctggtaaatgatattattagggtgccaccaaggtggggtgctaggctaggattacgaggaactgactaaaaggagtggcagggagctggcatcttgtcctttgggccatcggtgtggtcgatacatagtaggtcctcacagaaggtctgttaaatgactggggacgagggcctgcatcctgaggaggggatgaaaaggagagagaagaaaagactcagcccagctcactgccttaccgtgccccttagagccactgctggtgaagctggtctcggacctgacaccactcactgtccacgagggcgatgatgccacgttccggtgtgaagtctccccaccagatgccgatgtcacctggctgcgcaatggggccgtcgtcactccagggccccaggtggagatggcccagaatggttcaagccgcatcttaaccttgcgaggctgccaactgggggatgcagggaccgtgactttgcgggcagggagcacggccacaagtgcccggctccatgttcgagagacagagctgctgttcctacggcggttgcaggatgtgcgggcagaggaaggccaggacgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggcgacgggaacgcgcttacgcctagcccgcggctccggctccaggccctcggcacgcgccgccttctccagctgcgacgctgcggcccctcggacgccgggacctacagctgcgcggtggggacggcccgcgccggaccggtccgcctgaccgtgcgcggtgggtacggggtgatgtggaggctgggcactgctttgggcgcgagacttgcggagctgtcttccccggaccctgatgaccgcgcgtgcttctagaaagggggcgtggagggggcgtgaccggtaactgccctctgccccgccccgctcacgccccgggctccgccccagagcgtactgtggcggtactctccgagctgcggtcggtgagcgcccgcgaaggcgacggcgctacgttcgagtgcaccgtgtcggaggtcgagaccacggggcgctgggagctcggaggccgcccgctgagacccggagcccgcgtccgcatccaacaggaagggaagaaacacattctggtgcttagcgagctgcgcgccgaggacgccggtgaagtccgcttccaggcggggcccgcccagtccctggctctactggaagtggaggcattgcctctccagatgtgccgccacccccctcgcgagaagaccgttctggtgggccgccgggcggtgctggaggtgactgtgtcccgctcggggggccacgtgtgctggctgcgggagggggccgagctgtgcccgggagataagtatgagatgcgcagccacggccccacccacagcctggtcatccatgacgttcgacctgaggaccaaggcacttactgctgccaggccggccaggacagcacccacacacggctgctggtagagggcaactaggagaacctaaccaggccaggcgggtgcccttggacagcttggaaggcgtttgcccttaccctgggcaggggtagagagacaaggaacaataaaagtgctacagctca

SEQ ID NO: 344346 - DNA, 1306 bp, Homo sapiens
  misc_feature (622)..(622): n is a, c, g, or t
ttaggtcctgatgaggatgagatactctgtgtcccgtgcctgtactcccaaccaggattccagcagccttgcctctccacctagggacagaccagtgggatggagcaaggggccagcctccaaccccaccagactccatggcctccttcttccccaccagagacagagctgctgttcctacggcggttgcaggatgtgcgggcagaggaaggccaggacgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggcgtgagtgccccgtcctctcttaatgcattacccaccctacaccacagccttttctggctgtcctggagtccctcaggcccccaccaaagtgcccctcatcgctgagaaaagtcacccatggccgtcccagcagcagcttgcccaaagcaaaacttttctttttctaatattttttatttaccttagaantccatgtggattttgcattccattgcatatttccaagtcggctttgctataaacacaaatattctccagaaagacttgccatgggcatccttcaggcatgtattctagggatacacatacccacttaagtagcagggatggctgtcaaacagcaccccacacctcccacccaaagctggagccctctgtttcctatgtgacctcatgcaagttaacctctttgagccaagtctccttaaaaatggggctgagaccaggtgcagtggctcacgcctataatcctaacactttgggaggccaaggcaggaggatcccttgaggccaggagttcgaggccatcctgggcaacatagcaagaacccatctccacaaaaaaaataaaaattagccgggcatggtagttactagggaggctgaggcagaaggattgcttgaacccaggaggttgaggctatagtgagctatgatcatgtcacggcattccagcctgggtgacagcaagaccctgtctcaaattttaaaaatggggttgatccccgtctcaagtgtctctgggaacattaactgagataacatgaaaattcttacacagagcttggtgaatggttgtcattggtgacacatctcttctaacttatttcattcaagaaatcatcacaataaacctgtgtcccaatgttaaaa

SEQ ID NO: 344347 - DNA, 445 bp, Homo sapiens
tgcggactgcagtggcgcaatctcggctcaccgcaagctccgcttcccgggttcacgccattctcctgcctcagcctcctgagtagctgggactacaggcacccgccaccgcgcccggctaattttttgtatttttagtagagacggggtttcaccgttttagccaggatggtctcgatctcctgacctcatgatccacccgcctcggcctcccaaagtgctgggattacagacgtgagccaccgcgcccggccttgattgaccagttttgaaacactctctgtagaatctgcaaatggacatttggagggctttgcaactgatggtgcaaaaggaaatatcttcacataaaaactattctgaaacattctgacaaactcctttgtgatgtgtgcattcatctcatggagttgaaacttcctttgcattgaacagttttgaaaaa

SEQ ID NO: 344348 - DNA, 2939 bp, Homo sapiens
tgctcggagtgctgcctggcgctggctaggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtccccctgctgcacaggtcggagggtcaccgcagaggctactcgggctggggctggggccgagggagcccgcactggagccccatgtggaacccaaggatgcagctgctctgctaacacggcagcccatccttcgagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactcctcctcttcgtcaccccgctatacctccgacctggagcaggcccggcctcagacgtcaggggaagaggaactgcagctgcagctggccctcgccatgagccgtgaggaggcagagaagcctgtccccccagcctcccacagggacgaggacctgcagctgcagctggctctgcgcctgagccggcaggagcacgagaaggaggtgaggtcctggcagggtgatggctcccccatggccaatggtgcaggggccgtggtccaccatcagcgggacagagagcctgagagagaagagagaaaggaggaggagaagctaaaaaccagccagtcctccatcctggacttggctgacatcttcgtacctgccctggccccgccctccacacactgctctgctgacccatgggacatcccaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccaccacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgtcccccaccaacccgttcggcgcgggcgagacgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggccgcggcccccgcccccgcagaccggcaccaaccccttcctctgagccccgccccgtcccataccggcctgcgcctgcgccggacgctccgcggccccgcctccggacccggggctgggcggggcgccggtgctagtggaacgccgagccagtggcggctggtatcccgcggcggctctggaagctggacgcggaccacggcccgggagctagaaactgaacgcccgcataataaagactggaaccctcgttctcagctctcaccaagtggactttttgcggggtgtggcggccgggtctcgaccacagcgtggatcaccggctgtttaggaaactgcagctgcacaacgtggggtgcaaaactgccccgcttcctttacagctcttctcaaccctcacctccatcccccgtcacccaggcaccttcgcttccagatgctgccaggctgtcactcaattcggtcatttcattcatttatcacacatgggcactggggttgggctaacagcaagagacaataggcctttgttcctatttattgggtactgcttacgtgctaagcagatcagtttatttaatgcttgcaacgactctctgaggtagaaaatattgttaattccgttcaggatcccggctacataatctgtggggctcaatacaaaataaaaatgtaggggctccttgttcaaaat

SEQ ID NO: 344349 - DNA, 848 bp, Homo sapiens
tgctcggagtgctgcctggcgctggctaggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtccccctgctgcacaggtcggagggtcaccgcagaggctactcgggctggggctggggccgagggagcccgcactggagccccatgtggaacccaaggatgcagctgctctgctaacacggcagcccatccttcgagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggaggcaaggcacgcgcgaaaggacaaggaagccccagagaagaggcggggagaaccccccaaaacgggcagcaaaaggggagcacaaaaaaacgcccacacaaaaagtag

SEQ ID NO: 344350 - DNA, 2498 bp, Homo sapiens
tgctcggagtgctgcctggcgctggctaggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtccccctgctgcacaggtcggagggtcaccgcagaggctactcgggctggggctggggccgagggagcccgcactggagccccatgtggaacccaaggatgcagctgctctgctaacacggcagcccatccttcgagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactcctcctcttcgtcaccccgctatacctccgacctggagcaggcccggcctcagacgtcaggggaagaggaactgcagctgcagctggccctcgccatgagccgtgaggaggcagagaagcctgtccccccagcctcccacagggacgaggacctgcagctgcagctggctctgcgcctgagccggcaggagcacgagaaggaggtgaggtcctggcagggtgatggctcccccatggccaatggtgcaggggccgtggtccaccatcagcgggacagagagcctgagagagaagagagaaaggaggaggagaagctaaaaaccagccagtcctccatcctggacttggctgacatcttcgtacctgccctggccccgccctccacacactgctctgctgacccatgggacatcccaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccaccacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgtcccccaccaacccgttcggcgcgggcgagacgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggccgcggcccccgcccccgcagaccggcaccaaccccttcctctgagccccgccccgtcccataccggcctgcgcctgcgccggacgctccgcggccccgcctccggacccggggctgggcggggcgccggtgctagtggaacgccgagccagtggcggctggtatcccgcggcggctctggaagctggacgcggaccacggcccgggagctagaaactgaacgcccgcataataaagactggaaccctcgtt

SEQ ID NO: 344351 - DNA, 2288 bp, Homo sapiens
tgctcggagtgctgcctggcgctggctaggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtccccctgctgcacaggtcggagggtcaccgcagaggctactcgggctggggctggggccgagggagcccgcactggagccccatgtggaacccaaggatgcagctgctctgctaacacggcagcccatccttcgagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactgcccggcctcagacgtcaggggaagaggaactgcagctgcagctggccctcgccatgagccgtgaggaggcagagaaggaggtgaggtcctggcagggtgatggctcccccatggccaatggtgcaggggccgtggtccaccatcagcgggacagagagcctgagagagaagagagaaaggaggaggagaagctaaaaaccagccaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccaccacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgtcccccaccaacccgttcggcgcgggcgagacgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggccgcggcccccgcccccgcagaccggcaccaaccccttcctctgagccccgccccgtcccataccggcctgcgcctgcgccggacgctccgcggccccgcctccggacccggggctgggcggggcgccggtgctagtggaacgccgagccagtggcggctggtatcccgcggcggctctggaagctggacgcggaccacggcccgggagctagaaactgaacgcccgcataataaagactggaaccctcgtt

SEQ ID NO: 344352 - DNA, 340 bp, Homo sapiens
gatggggtcctgctacattgcccaggctggcatcaagcagtctttctgccttagagtaagttttaatgctagtgtccctcagtttacttagctcttttcttatcagtgaagtttatttagtaagggaagagaacaaaaatatgtgagagaatttatatgtagaaaacaatatgtatttttagccaaatatatatttggtagtttacatatatatgacacagagtatcagagccatagaccatttaaaattatagccaggtgcggtggctcacgcctgtaatcccagcactttgggaggccgaggtgggtggatcacctgaagtcaggagtttgagaccag

SEQ ID NO: 344353 - DNA, 837 bp, Homo sapiens
tctatgtagttatgtgaaccgtttgcagtggtggtgtttaccttttttattgacacaaaccaaaaatgtaatcagaatgttacctttatatgttacaaaaaagtatgatttttctttcattttaatttttctaaagcttgcaaataaacgtattcagaatatgcaacacctaaagaaagagaagaggagactgaataaaaggttttcaaggccttctcctattccagaaccaggactcctatggtcatcttgataaagcaggagtctatttgaaggaaaccatgctccagacagaaatatgtggattgtgaacatcaagtgacatatcatgaattgatcatccacaaaataaatgcaatactccaccatttcggaaaaataaacacagtgcaagtatttaatatccaagctacaggctctagaattttattaaatgccatctctcactaccatatttttctttcctgtggtaaacttgaaatttgctgcttttcaacaaataataatgaatatgtataggtagacttttgaaaaatattattctcatttaaatttttgcaaatgttttatgacatatttagatgtttagaagtatgttataataatagaacaccagatttcctctgctgtatatttataatgacttccatttaaacaaaatgtttaaatactttaaacagtcctaggagactgttattataactaactcctgtattttgtgttgctattgcagataagccatagtgtaattaaaatttccatttaaggtaaaatttgaatattgaattaaaattttacttttaggtatgaaataaattataattattgctgactctc

SEQ ID NO: 344354 - DNA, 893 bp, Homo sapiens
tctatgtagttatgtgaaccgtttgcagtggtggtgtttaccttttttattgacacaaaccaaaaatgtaatcagaatgttacctttatatgttacaaaaaagtatgatttttctttcattttaatttttctaaagcttgcaaataaacgtattcagaatatgcaacacctaaagaaagagaagaggagactgaataaaaggttttcaaggccttctcctattccagaaccaggactcctatggtcatcttgataaagcaggagtctatttgaaggaaaccatgctccagacagaaatatgtggattgtgaacatcaagtgacatatcatgaattgatcatccacaaaataaatgcaatactccaccatttcggaaaaataaacacagtgcaagtatttaatatccaagctacaggctctagaattttattaaatgccatctctcactaccatatttttctttcctgtggtaaacttgaaatttgctgcttttcaacaaataataatgaatatgtataggtagacttttgaaaaatattattctcatttaaatttttgcaaatgttttatgacatatttagatgtttagaagtatgttataataatagaacaccagatttcctctgctgtatatttataatgacttccatttaaacaaaatgtttaaatactttaaacagtcctaggagactgttattataactaactcctgtattttgtgttgctattgcagataagccatagtgtaattaaaatttccatttaaggtaaaatttgaatattgaattaaaattttacttttaggtatgaaataaattataattattgctgactctcaaaagccgttatttgtaggatgaaatggataaacaaattggccttgctggcctcaa

SEQ ID NO: 344355 - DNA, 796 bp, Homo sapiens
acggcatgtgcctgtattgctgggacatcgagccttcccaagtcaaccctgaaggaccaagacaacatcatccttcagaggtcactgagcggcagcttgcaaataaacgtattcagaatatgcaacacctaaagaaagagaagaggagactgaataaaaggttttcaaggccttctcctattccagaaccaggactcctatggtcatcttgataaagcaggagtctatttgaaggaaaccatgctccagacagaaatatgtggattgtgaacatcaagtgacatatcatgaattgatcatccacaaaataaatgcaatactccaccatttcggaaaaataaacacagtgcaagtatttaatatccaagctacaggctctagaattttattaaatgccatctctcactaccatatttttctttcctgtggtaaacttgaaatttgctgcttttcaacaaataataatgaatatgtataggtagacttttgaaaaatattattctcatttaaatttttgcaaatgttttatgacatatttagatgtttagaagtatgttataataatagaacaccagatttcctctgctgtatatttataatgacttccatttaaacaaaatgtttaaatactttaaacagtcctaggagactgttattataactaactcctgtattttgtgttgctattgcagataagccatagtgtaattaaaatttccatttaaggtaaaatttgaatattgaattaaaattttacttttaggtatgaaataaattataattattgctgactctc

SEQ ID NO: 344356 - DNA, 3217 bp, Homo sapiens
agcggggcggccgggccagcgcggggcgcccgcgggcaggggcggcgagtgcgcgggcgctcgccgccgcccttctcggcgggcagcgcgcgaggaccaggccgaggaggaagtggcggcggcggcggcgggactgcgcgccccagctccgatccccgttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattttctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcgtgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggtgtctgggctgtgctccctcactaaagggaaggaaaggaagctgggcgtcctccgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccaccccctcgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctccgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgca

SEQ ID NO: 344357 - DNA, 3185 bp, Homo sapiens
agcggggcggccgggccagcgcggggcgcccgcgggcaggggcggcgagtgcgcgggcgctcgccgccgcccttctcggcgggcagcgcgcgaggaccaggccgaggaggaagtggcggcggcggcggcgggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattttctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcgtgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggtgtctgggctgtgctccctcactaaagggaaggaaaggaagctgggcgtcctccgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccaccccctcgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctccgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgcatttcacacgtgtttacacatgttgctcaagtttgttatgtcatactcccagtccttaaaagacgtttaataaaacagctttacctttta

SEQ ID NO: 344358 - DNA, 3003 bp, Homo sapiens
agcagacgcctctgccccctacacacacacacacacacacatacacacacacacatgcacgcgcacacacgcacgcacaccaagctgagctgcctgttggtgtgtcctcctgaggctgggacttgctggtctctgaggagcacgtggtctggccctgatgtgcgctgtgtctactggagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattttctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcgtgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggtgtctgggctgtgctccctcactaaagggaaggaaaggaagctgggcgtcctccgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccaccccctcgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctccgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgca

SEQ ID NO: 344359 - DNA, 3235 bp, Homo sapiens
agcggggcggccgggccagcgcggggcgcccgcgggcaggggcggcgagtgcgcgggcgctcgccgccgcccttctcggcgggcagcgcgcgaggaccaggccgaggaggaagtggcggcggcggcggcgggactgcgcgccccagctccgatccccgttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaaggcctcccttctgccctagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattttctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcgtgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggtgtctgggctgtgctccctcactaaagggaaggaaaggaagctgggcgtcctccgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccaccccctcgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctccgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgca

SEQ ID NO: 344360 - DNA, 2742 bp, Homo sapiens
actgaggtttggggcttccaccccttgacagcagagctgaaccttagccggccgatcgaggagcagggccccctggacgtcatcatccacaagctgactgacgtcatccttgaagccgaccagaatgatagccagtccctggagctggtgcacaggttccagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattttctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcgtgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggtgtctgggctgtgctccctcactaaagggaaggaaaggaagctgggcgtcctccgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccaccccctcgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctccgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgca

SEQ ID NO: 344361 - DNA, 2557 bp, Homo sapiens
agcggggcggccgggccagcgcggggcgcccgcgggcaggggcggcgagtgcgcgggcgctcgccgccgcccttctcggcgggcagcgcgcgaggaccaggccgaggaggaagtggcggcggcggcggcgggactgcgcgccccagctccgatccccgttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattttctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcgtgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggtgtctgggctgtgctccctcactaaagggaaggaaaggaagctgggcgtcctccgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggctccctggatggcgacgtctctgtaatgccatgttggcagaacttgctggaaatccgccctctggactttactggagatccatctttttgggtctcaaggaaagttgtctgtggcaggtatcttactgtaagcacaccgctgctacgttttcccaggggagtgctggcagaagctcctggctgttgggtcctcttgcatagcgtgttgctgtatcg

SEQ ID NO: 344362 - DNA, 2789 bp, Homo sapiens
agcggggcggccgggccagcgcggggcgcccgcgggcaggggcggcgagtgcgcgggcgctcgccgccgcccttctcggcgggcagcgcgcgaggaccaggccgaggaggaagtggcggcggcggcggcgggactgcgcgccccagctccgatccccgttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggggactgccaagtgtgctttatagaaggctggaagaccgactgaagtaggaagctgtcacatgtttgagccaactgagcaaagcagctgttgcctgccagacagccaccccaagaccaagggagccagcctgtcgtttgtccttctagcctggaagaccagttcttggctcttgggcactcacattggccactggccgcaactgctgaatggcttcactaatgtccctggggtctgtatctgccctctcttctattccctagaaactctggccgggcatggcggctcacgcctgtcatcccagcacttagggaggccgaggcaggtggatcacaaggtcaagagatcgacaccatcctggccaacatggtgaaaccccatctctactaaaaatacaaaaattagctggacatggtggtgggcgcctgtagtcccagctacttgggaggctgaggcaggagaattgcttgaactcgggaggcgtaggttgcagtgagccaagatcgcaccactgcactccagcctggcaacagagcaagactcctcaaaaaacaaacaaacaaacaaacaaactctgatcattcacccggtgggatccccggcagctccttctccttcccgagctgtggctcatgggccattggattcagagaccttgagctgggtgctggctgccctaaaggagcacgacccctccagcctggtgaccgggaggcagagaagtgcagctgtccttgacaaaggcccagcctctgctgcctcaggccagcctggccacaccccgatgccacagtcatctgccccgcccaggcataagcctgactcaggtgatacaggcgaggcttctcccatgggtcctccccttgtgagaaagggtctgtgctgtgtaccttctctctgcacagccattgtcagtgtggtttggagtgagtgagcctcccgcactgctcaggggagagctggtgagcatgactccatggcctcctgctggttggggtcttcttctgattctcacccgcaggagcacccagacccccccttttcagaaatgattacattttcccttcaagagtcatctgtgacctggtggtgtggagggactgtcccctcctacagcctggccgacccccttcctccagggctgtgtggaatcacctctcagaagctcactctgaaaagccactcacagggatttcaccaggatgttgctgttcctgccgacacctgggctttgtgacaaatgctgtttgcttcaagctgttcacaagcaacttcaccagaatcccaagctggttcgtacttaatttgtatacatacatatgcataatatacatgaccatgtatgagatacagacaccatggcttctgtccattggctcattcgcctggtcgcatgttcactccatgaggttaggacactgcgggtggctttgggatgggtggtttcagggacaaggtgtcgctgtgatctctgtatttgctaactagtcttgttttgatttctaacggtctagtggagtacagttaatgttgtgtttatttctgtaactgtaggggtggagtataaacctaacttttggaaacatgaagaaataaacaatagcgccagccgttag

SEQ ID NO: 344363 - DNA, 3574 bp, Homo sapiens
agcggggcggccgggccagcgcggggcgcccgcgggcaggggcggcgagtgcgcgggcgctcgccgccgcccttctcggcgggcagcgcgcgaggaccaggccgaggaggaagtggcggcggcggcggcgggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattttctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcgtgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggtgtctgggctgtgctccctcactaaagggaaggaaaggaagctgggcgtcctccgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccaccccctcgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctccgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgcatttcacacgtgtttacacatgttgctcaagtttgttatgtcatactcccagtccttaaaagacgtttaataaaacagctttaccttttaaaaataaaatttcaatcccagtctgcctcaggtacgggtgggggtgtgcagcgtgactcctggctgtgttcctgtaccgtttgtggcctccggggtcttgcgcgtccagggcccagataccgagtaactgccatgtggtgtcgtggtggcgtccataggcctccgtggtggggcgggggcggggctgtgggtgtgcagggcagctgcattttccaagagtggagatggaggatggagatttgcttcgtaaaggcctgggagctacatgggaggtagggaggggccagccacacccagggctggggggccggtggactctgcccagtgaagccaggggagtgtcagcaatgaggggcctggacagcgacgcgggacccgcacctgggagc

SEQ ID NO: 344364 - DNA, 3674 bp, Homo sapiens
agcggggcggccgggccagcgcggggcgcccgcgggcaggggcggcgagtgcgcgggcgctcgccgccgcccttctcggcgggcagcgcgcgaggaccaggccgaggaggaagtggcggcggcggcggcgggactgcgcgccccagctccgatccccgttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattttctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcgtgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggtgtctgggctgtgctccctcactaaagggaaggaaaggaagctgggcgtcctccgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccaccccctcgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctccgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgcaaaaaaaaaaaaaaaaaaaaaaaaaaaaaaaaaaaaaaaaaaaaaagaaaaaaaaaaaaaaaaaaaaaaaaaaaaccactgggtggggcgcgcagccacccgcccccatcaaaaaaatatttaagaacaacccacgtgggggggggcgcgaggccccacagtggtgatgatcagacagcaggggtacaacagggtgtccactaagaaacacccctgggggacgacacgacgcgggggggcggatccacccaacaaaaaaaaaaaacacgcgcgcggcgaggaaaccacaaggggtttttttacaacaacacaacacagaggggggaggctcacttggggaggccacgaaggcggcgagctaccaacacagggggggtcatcaagagagcgcactaataaaagttaccccaggggtgtgagtaaaacaaaaaaagagactagggacatacgaaacagcg

SEQ ID NO: 344365 - DNA, 3089 bp, Homo sapiens
agcggggcggccgggccagcgcggggcgcccgcgggcaggggcggcgagtgcgcgggcgctcgccgccgcccttctcggcgggcagcgcgcgaggaccaggccgaggaggaagtggcggcggcggcggcgggactgcgcgccccagctccgatccccgttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcgagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattttctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcgtgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggtgtctgggctgtgctccctcactaaagggaaggaaaggaagctgggcgtcctccgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccaccccctcgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctccgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgca

SEQ ID NO: 344366 - DNA, 3084 bp, Homo sapiens
agcggggcggccgggccagcgcggggcgcccgcgggcaggggcggcgagtgcgcgggcgctcgccgccgcccttctcggcgggcagcgcgcgaggaccaggccgaggaggaagtggcggcggcggcggcgggactgcgcgccccagctccgatccccgttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattttctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcgtgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggtgtctgggctgtgctccctcactaaagggaaggaaaggaagctgggcgtcctccgggccccccaacacacgtcccatttagccctgtctttgggcctccaccccctcgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctccgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgca

SEQ ID NO: 344367 - DNA, 446 bp, Homo sapiens
ctcccaggttcaagcaattctcctgtctcagcctcccctgtagctgggattacaggtgtacatcaccatgcctggctaatttttgtatttttagtagagacggggtttcaccatgttggtcaggctggtcttgaactcctgacctcaggtgatccgcccatccctgcctcccaaagtgctgggatcacaggcttcagtcaccgtgcctggcctgtttagggagcaaaaaattcaatgtttttgaagccagctgcagtcggggttcctgtccgttggatctaaagggaatctattgccatgagcatcacacatcttcaagagcaaacagggcagccaggaagtgtgttcccttgctcaagcagaactcacacatcaacatcacctcctcagaaccgagggggacacagccagagtaaaattgctgagtagaaggagatgtccatttt

SEQ ID NO: 344368 - DNA, 1013 bp, Homo sapiens
gctggtcgaggcccggtgattaatcggccgaggaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaacggggccttttcctggccggggggggatccgtgctgttggagtccaccgtggtggcacgatccctagcttatgcgatgtcggccagaaccagggggtccctgggaggggaccatcccacgcggtgggagccttaaaggcggtcacactggccgggacctctccaatcaggtgggcgcccgacccgcctcgggggccccccgctctcgcctccgcctggcttcaggcgctacagcctccctatcgcccagccctcctcccacgtgcgtgtagtatagttcacact

SEQ ID NO: 344369 - DNA, 1007 bp, Homo sapiens
  misc_feature (34)..(34): n is a, c, g, or t
  misc_feature (42)..(42): n is a, c, g, or t
  misc_feature (47)..(47): n is a, c, g, or t
tgacaacaaaagaaaagaaaacctcagctagtangaggctgngtttnaatcggccgaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggcaaagtcttgatgaagtagggatgatgaacattgggggtgaagaaacaatagtcaaataaagggatgtgggaatggcctgtaaatctggcccttaaggatggtgaaacatccaaaagaaacggttaggggatttgagaagaaaacagttgtggcatgtgaataaatgagaatatatagaaagg

SEQ ID NO: 344370 - DNA, 5425 bp, Homo sapiens
tattaatgacgggaggaagaaaggcacaagcgctgagaaactgcaaaggctgtgggattggggttaccagagggtgcagtgacaatggggtaggagtggggtgctagtcagaaagttcagagtaggggtggttggaggcagcgttgagaaggagcaagaagtgtcagggtggtgatggcgtcttagaagatctccaggttttgggagaagatgggtgtatgggttaccacaataggactagactaatacaagggttcagtctattgtgccacgttcttccaggaggataaactccggagccaatgaactggagccaagtgggagagtccgcctctaagggattaaagggtctcctttcactaatcgatctcgccctattcctttcgttgattggctgagaattccaatccgtcgaggaagcgtagcgttgcggccaattgacgtggcgttactaggcgtgtcgcatcactgaggcgggagccaggccgcaagcgaatttcctgattggctgtgatctgcgggttgctggggagaggcgcggagaggcgggcgagagtccgcagggcaggcgctgattggctgaggtgggagcagcttcccttccgatgattcggctcttctcggctcagtctcagcgaagcgtctgcgaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatggagcctgagtcctgggccctgtgcctgcttcttttcctgggaacagccttgggctacccaccactcccaaggcattcttccaaatgtgaaatcctggaagtaagattgcaccttcttcctctcctgatcaacatcggtatgatgtctcctgttgcctcaccctttgtctgcagtatcactggataggactggtggaaagggagcagcctgacagagctccaaatgtggagaatatggcatccctccacctatatttgatgtggacggtaaggctaggcctgcaggatcccttatcctgaccaaagactgtgttggggtgccatttgaaaatcgcagggttgcaaaagaatacaatcttacttgcaggtggatattctctatactctcttttaatgcatctaaaaatcccaaacatcccctggttggtgatcacttacagttgtgtccacctttattttatgtactttgattaaaaaaaaaaaactttttgttaatataaaaaaaaaaaaaaaaaaactcgagttttttttttttttttttgatgttgcttccaactgttttattgctaaactatcatgatacaagccgtataaaaatactttacatataggaaaaataaactacattaaactggagattaaaaacatttgcataggaatgtgatgtattcaaacgcctttaacagtcaggattttctaaacctaagcctgccagcaccaccatgttggagagacctgtttgttggagaattggttttctctcctctgagggctgtagaggccagaggggtgagtgaggttctttgacaagatgtccaggatgctaagcttgtcccaacagccatagcctcggtctgctcaggccaatcagaatgctgtgagcacctgctctaatggaaacaacatcatttgcatccattccattcaaagcttgaactcagcagggagtttattctggtcagccaacagctgcataaaggtagaatgttaataaccctttcacttccagctcccaggaccctgatggctcagggagcaactctctgttatcaaccaccagaaaagtttgtttttaaacagactgagttaaacagtgatgttggctgtaagtcaaggcactcacaaaagctgagggaaatggatgtttatgatcacaattttataggatgctgctttttcttaagcatttaattggaatgcaggaaaatacttgctatgcaattggctgctttggttccacgaaacgtaatgccctagcctcgagcctaggagacccaaggttaagatgcgctgggtcaccgagcaccttgcctccgggaaacaagttcgggaaaggttagcccagcttgtcaagaacgtcacaactccatccatgcctcttgtaaacttgaaatgaaaacattctttcaattctgagcaatagaaagcacttggaaaggtctttttttttttttttttttgacatgataaattcagcctcactgtagtccagagtgagaattagaacataccaacttccaatctgcctaaatgtgaggctgaatttatcatgtc

SEQ ID NO: 344371 - DNA, 1079 bp, Homo sapiens
tattaatgacgggaggaagaaaggcacaagcgctgagaaactgcaaaggctgtgggattggggttaccagagggtgcagtgacaatggggtaggagtggggtgctagtcagaaagttcagagtaggggtggttggaggcagcgttgagaaggagcaagaagtgtcagggtggtgatggcgtcttagaagatctccaggttttgggagaagatgggtgtatgggttaccacaataggactagactaatacaagggttcagtctattgtgccacgttcttccaggaggataaactccggagccaatgaactggagccaagtgggagagtccgcctctaagggattaaagggtctcctttcactaatcgatctcgccctattcctttcgttgattggctgagaattccaatccgtcgaggaagcgtagcgttgcggccaattgacgtggcgttactaggcgtgtcgcatcactgaggcgggagccaggccgcaagcgaatttcctgattggctgtgatctgcgggttgctggggagaggcgcggagaggcgggcgagagtccgcagggcaggcgctgattggctgaggtgggagcagcttcccttccgatgattcggctcttctcggctcagtctcagcgaagcgtctgcgaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgagtgagtgtgcgcgcgccgttcgcttgctgcggcggcgcgcaccgggaccagccgcgcagggtaggcccggcggggcctggccgtgggcgcgtcagagaggtggagaccaggaaagagggaagggaagctagggggcgagtgaggggccgtggacccggcaggc

SEQ ID NO: 344372 - DNA, 431 bp, Homo sapiens
gtgtggtagtctgaggtccctcacagcttcgggctaacctgcgcattcccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggtgagtctgcatcctttccccagatgtgccaatcatggagagccaggcagcagccaccaccatgccctggagttgagagtagaagctgttggaaagatcatctaactgagaagaattttaatagggcatcaaagataaagaatgctgaggtgaatccattcaatttggaataaggccgagaagagatggtcaggctccattctcagtctgaacca

SEQ ID NO: 344373 - DNA, 313 bp, Homo sapiens
tacctctgctgctgcttttaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagagagagtgtgtgattagaagctaaataggaaagttttgaacttcaagtcagtgaggaggaagaagaatttggacttgatgaagaagatgaagatgaggatgaggatgaagaggaggaagaaggtgg

SEQ ID NO: 344374 - DNA, 287 bp, Homo sapiens
agaggttaggtaacttgcccaagatcacaattaagcagtggcataattggaattcagacccaatgggtctgactatagagttcctgctcttaaccactcttctgtaagtctaagactatttttatttctctaacaactattcagcctccatttctattatgtcttcttcttaggccattattttctgaccctggggcaggatcactcacttggggccttatagctgggacactgacgctcaaaataccaggagctgctggaatgggtattgtaatatgtatggtaga

SEQ ID NO: 344375 - DNA, 626 bp, Homo sapiens
ctttggtccccggagagagcaggccccgcgagcccgaggccccagccgggcccggtgggcgtggactttgcgccatgtgaaggcctcaggagctctgccaccgaggcggagcccggggtcggggaaggcccgccgagctcagggaagctcacagccgcctttttggagccgggtcggcggggccggaggtgggcatcctctgtgtgtgacctgagtcgtgaaggactgttagggagagggcgagccctacctttcgcttctggtcttcttactttaggcctgttgttcatactagaaagtttgagccagttttccttaatgttatgactcgtgggtggggagaaaggaatttttctttaacattttaggttcttgctaaagttggaatctcagttcgtgttttgtgcgcctttccagatttccaggtttcgtggtgtgcagtttagagttgcactaactcttcaaaaacacaaacgtgcgcgcactcctttccccaaccagctatattgagaaattacccgggctctggggctttctgaccccacctccatccttaggaaagcgttagataaaacttggctacctcagcccattcaatttagaatagagagcttttagaggcaaaa

SEQ ID NO: 344376 - DNA, 3259 bp, Homo sapiens
gctggtcgaggcccggtgattaatcggccgaggaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgga

SEQ ID NO: 344377 - DNA, 4826 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatggagcctgagtcctgggccctgtgcctgcttcttttcctgggaacagccttgggctacccaccactcccaaggcattcttccaaatgtgaaatcctggaagtaagattgcaccttcttcctctcctgatcaacatcggtatgatgtctcctgttgcctcaccctttgtctgcagtatcactggataggactggtggaaagggagcagcctgacagagctccaaatgtggagaatatggcatccctccacctatatttgatgtggacggtaaggctaggcctgcaggatcccttatcctgaccaaagactgtgttggggtgccatttgaaaatcgcagggttgcaaaagaatacaatcttacttgcaggtggatattctctatactctcttttaatgcatctaaaaatcccaaacatcccctggttggtgatcacttacagttgtgtccacctttattttatgtactttgattaaaaaaaaaaaactttttgttaatataaaaaaaaaaaaaaaaaaactcgagttttttttttttttttttgatgttgcttccaactgttttattgctaaactatcatgatacaagccgtataaaaatactttacatataggaaaaataaactacattaaactggagattaaaaacatttgcataggaatgtgatgtattcaaacgcctttaacagtcaggattttctaaacctaagcctgccagcaccaccatgttggagagacctgtttgttggagaattggttttctctcctctgagggctgtagaggccagaggggtgagtgaggttctttgacaagatgtccaggatgctaagcttgtcccaacagccatagcctcggtctgctcaggccaatcagaatgctgtgagcacctgctctaatggaaacaacatcatttgcatccattccattcaaagcttgaactcagcagggagtttattctggtcagccaacagctgcataaaggtagaatgttaataaccctttcacttccagctcccaggaccctgatggctcagggagcaactctctgttatcaaccaccagaaaagtttgtttttaaacagactgagttaaacagtgatgttggctgtaagtcaaggcactcacaaaagctgagggaaatggatgtttatgatcacaattttataggatgctgctttttcttaagcatttaattggaatgcaggaaaatacttgctatgcaattggctgctttggttccacgaaacgtaatgccctagcctcgagcctaggagacccaaggttaagatgcgctgggtcaccgagcaccttgcctccgggaaacaagttcgggaaaggttagcccagcttgtcaagaacgtcacaactccatccatgcctcttgtaaacttgaaatgaaaacattctttcaattctgagcaatagaaagcacttggaaaggtctttttttttttttttttttgacatgataaattcagcctcactgtagtccagagtgagaattagaacataccaacttccaatctgcctaaatgtgaggctgaatttatcatgtc

SEQ ID NO: 344378 - DNA, 3914 bp, Homo sapiens
  misc_feature (3846)..(3846): n is a, c, g, or t
  misc_feature (3852)..(3852): n is a, c, g, or t
  misc_feature (3856)..(3856): n is a, c, g, or t
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatggagcctgagtcctgggccctgtgcctgcttcttttcctgggaacagccttgggctacccaccactcccaaggcattcttccaaatgtgaaatcctggaagtaagattgcaccttcttcctctcctgatcaacatcggtatgatgtctcctgttgcctcaccctttgtctgcagtatcactggataggactggtggaaagggagcagcctgacagagctccaaatgtggagaatatggcatccctccacctatatttgatgtggacggtaaggctaggcctgcaggatcccttatcctgaccaaagactgtgttggggtgccatttgaaaatcgcagggttgcaaaagaatacaatcttacttgcaggtggatattctctatactctcttttaatgcatctaaaaatcccaaacatcccctggttggtgatcacttacagttgtgtccacctttattttatgtactttgattaaaaaaaaaaaactttttgttaatataaaaaaaaaaaaaaaaaaaaaaaaaaaaaaatttatatattattaaaaaaaaaaattccttgagggggggcccggnccccanttcnccctataggagaggcgattacaattaccgtggccggcttttacaacgtcgggactggg

SEQ ID NO: 344379 - DNA, 3492 bp, Homo sapiens
  misc_feature (3332)..(3333): n is a, c, g, or t
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatggaaaaaaaaaaaaaaaaaaaaaaaaaaaaaaaaaaaaaaaaaaaaaaaaaaaaaaaaanncaagtttatgcatgcggccgaatttagagttacttggccaatccccctatggggggtcgtataaaaatccactggccggcgtttacaccgtggaattggaaaaccttggggttcccaactattggctttgagaaattccctttcgcagctggttatacc

SEQ ID NO: 344380 - DNA, 3331 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatggacatttccagcatggagttcccagattacgaggtacatcaaggaacagctatgccat

SEQ ID NO: 344381 - DNA, 3222 bp, Homo sapiens
  misc_feature (34)..(34): n is a, c, g, or t
  misc_feature (42)..(42): n is a, c, g, or t
  misc_feature (47)..(47): n is a, c, g, or t
tgacaacaaaagaaaagaaaacctcagctagtangaggctgngtttnaatcggccgaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgga

SEQ ID NO: 344382 - DNA, 3146 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgttcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgga

SEQ ID NO: 344383 - DNA, 3233 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgga

SEQ ID NO: 344384 - DNA, 3337 bp, Homo sapiens
  misc_feature (390)..(390): n is a, c, g, or t
cagataacacaaatacagttaaaggactgaacctagcctttcattgccatcaaccagctgaaaccagtctgtaaccctccatttaaccactctccccaagtcagcaaatgaaatctaaagatggacaagagctctttattggccaggcatggtggctcacgcctgtaatcccaacaccctgggaggctgaggtgggtggatcacttgaggccaggagttcgagaccagcctagccaacatggcaaaaccccacctctaccaaaaaagcaaaacgaaaacgaaacattcaacgggcatggtggcagacacccgtaatcccagctactcgggaggctgaggcacaagaatcctaagaacccaggaagtagaagttgcaatgaaccacgaccntgccactgtacaacagagcaagactgcgcatcttgcgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgga

SEQ ID NO: 344385 - DNA, 2605 bp, Homo sapiens
agggactgggtgcttaaggttgtaacattaacatggcccgttgtctttacaatttataacgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgga

SEQ ID NO: 344386 - DNA, 2687 bp, Homo sapiens
  misc_feature (2620)..(2620): n is a, c, g, or t
  misc_feature (2633)..(2633): n is a, c, g, or t
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcncttcaggaacagntggactgccctgtcgggctagtcggggggtaccagctcgattctatcatgtata

SEQ ID NO: 344387 - DNA, 2972 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatggacatttccagcatggagttcccagattacgaggtacatcaaggaacagctatgccat

SEQ ID NO: 344388 - DNA, 2119 bp, Homo sapiens
ccctgggcgtgtaatcggacgaggggaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgga

SEQ ID NO: 344389 - DNA, 2055 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggttgatgactcggtcagcagccccaccaccatctccaatgttacctccacgagccttggcaatcgaatccagctcatcaaagaatagcacacagggggcagct

SEQ ID NO: 344390 - DNA, 1060 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggcaaagtcttgatgaagtagggatgatgaacattgggggtgaagaaacaatagtcaaataaagggatgtgggaatggcctgtaaatctggcccttaaggatggtgaaacatccaaaagaaacggttaggggatttgagaagaaaacagttgtggcatgtgaataaatgagaatatatagaaagg

SEQ ID NO: 344391 - DNA, 962 bp, Homo sapiens
aagggccctgggggtgtgcgaaaatttcgggcacggaatggcagcaagaacttttggcccatgcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgga

SEQ ID NO: 344392 - DNA, 1029 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaacggggccttttcctggccggggggggatccgtgctgttggagtccaccgtggtggcacgatccctagcttatgcgatgtcggccagaaccagggggtccctgggaggggaccatcccacgcggtgggagccttaaaggcggtcacactggccgggacctctccaatcaggtgggcgcccgacccgcctcgggggccccccgctctcgcctccgcctggcttcaggcgctacagcctccctatcgcccagccctcctcccacgtgcgtgtagtatagttcacact

SEQ ID NO: 344393 - DNA, 629 bp, Homo sapiens
aatccgtaatatcgtattgcctttattctgatgtaacaagcgcctggcagaccttgacggtcttgtacttgtaaaacccctttccggagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgga

SEQ ID NO: 344394 - DNA, 306 bp, Homo sapiens
cccttgtaatattgggtcaccagtattagctagaaggggatcatccttggatatctccctgaagaccctgcatgtctttgtggggtttctaaatgtgtggctcttgattttggctcactgattaggagtgagtggggctgttccttcgccctcacttccaccctgttctccttcctctcttcgcctaaagccatcctgccttttctttttcacttactatcagctatctgtgccaggcccttttggacacccagtgcttgggcccgaagtgtggttggtaatatggagtctgcttgtcatcctcag

SEQ ID NO: 344395 - DNA, 374 bp, Homo sapiens
gcccttggtctgtctaaaattgagcccttagtgtaatggcctcttgcctttccctagtcatgtatcttcaaacgcatttggactacagtttctctgcccttagtctcctatgcaagttgcaatcataaatgttgcccactttctagcagtattttccctgctagtaatagaaatgagtgtggcctaaagtaattgtcttcttagcatttactgcggagggcttattcttaatattgtcagggttgaagcctgattctcaccctctctggagcgctagtcaagccattttagggtttgggagaaggtgggaacctaatcacactctgcattggtccaccctcctagaggaatcctgctttacggacctcctggaa

SEQ ID NO: 344396 - DNA, 193 bp, Homo sapiens
acctgggaagacatcgggggcctagaggatgtcaaacgtgagctacaggagctggtccaggtagggcaacttggtccagggtgagtcactgtctcagtacattgtaattgacctgggtgatctcagggtgtcaacacatttgctgcaagagttgtgagagcacgacttaggaacctactgttcttaggtttga

SEQ ID NO: 344397 - DNA, 404 bp, Homo sapiens
ccaggagctgctggaatgggtattgtaatatgtatggtagatactgctcctcgtgaccttggctgcctttccttcatctgagctttctggtctagggacagcttcatctattcactgtttctttcctaagtatgagttttagagactggcgaggcgcttggggcaggagtatctactgactccatttcctccttctagttcaaaaggtgatgacctatcaacagccattctcaaacagaagaaccgtcccaatcggttaattgttgatgaagccatcaatgaggacaacagtgtggtgtccttgtcccaggtaagctgtggccacagactagtctttccttactgcacttacttgagggattttcccaggtttcttttctcatttttcttgcagtgactgcaga

SEQ ID NO: 344398 - DNA, 953 bp, Homo sapiens
  misc_feature (884)..(884): n is a, c, g, or t
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagagaggaaagnctgcaagaacgggataacaactggggcaggaacctactcaaaagacatggaaagcccaaaaggcctaca

SEQ ID NO: 344399 - DNA, 675 bp, Homo sapiens
aacgagatatgtcatagtacggcccgggttgcaattcagtcgcggagggctggcgtacagtcagtaagagaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagcagctatgtgaagtacggcaaacgattagagatactgtattcgtg

SEQ ID NO: 344400 - DNA, 520 bp, Homo sapiens
ctctagagtatccccccctgcaccttcctgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcatggggggaccatatggtggaggaaactatggtccaggaggcagtggaggaagtgggggttatggtgggaggagccgatactgagcttcttcctatttgccatgggcttcactgtataaataggagaggatgagag

SEQ ID NO: 344401 - DNA, 392 bp, Homo sapiens
aaggatcccgtgtgaagctgcactctcatacttgatttcctcatggagctggtcagactgagaatggagcctgacctgacagagatttgccagcgtgcttgcaagctggccatccgtgaatccatcgagagtgagattaggcgagaacgagagaggcagacaaacccatcagccatggtgagtctgcatcctttccccagatgtgccaatcatggagagccaggcagcagccaccaccatgccctggagttgagagtagaagctgttggaaagatcatctaactgagaagaattttaatagggcatcaaagataaagaatgctgaggtgaatccattcaatttggaataaggccgagaagagatggtcaggctccattctcagtctgaacca

SEQ ID NO: 344402 - DNA, 3275 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgga

SEQ ID NO: 344403 - DNA, 3265 bp, Homo sapiens
cactagctagggtataggtagcgaggctgggtggccgagaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgga

SEQ ID NO: 344404 - DNA, 2933 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggta

SEQ ID NO: 344405 - DNA, 3976 bp, Homo sapiens
  misc_feature (3780)..(3780): n is a, c, g, or t
  misc_feature (3795)..(3795): n is a, c, g, or t
  misc_feature (3803)..(3803): n is a, c, g, or t
  misc_feature (3836)..(3836): n is a, c, g, or t
  misc_feature (3841)..(3842): n is a, c, g, or t
  misc_feature (3844)..(3844): n is a, c, g, or t
  misc_feature (3847)..(3847): n is a, c, g, or t
  misc_feature (3860)..(3860): n is a, c, g, or t
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatggagcctgagtcctgggccctgtgcctgcttcttttcctgggaacagccttgggctacccaccactcccaaggcattcttccaaatgtgaaatcctggaagtaagattgcaccttcttcctctcctgatcaacatcggtatgatgtctcctgttgcctcaccctttgtctgcagtatcactggataggactggtggaaagggagcagcctgacagagctccaaatgtggagaatatggcatccctccacctatatttgatgtggacggtaaggctaggcctgcaggatcccttatcctgaccaaagactgtgttggggtgccatttgaaaatcgcagggttgcaaaagaatacaatcttacttgcaggtggatattctctatactctcttttaatgcatctaaaaatcccaaacatcccctggttggtgatcacttacagttgtgtccacctttattttatgtactttgattaaaaaaaaaaaactttttgttaatataaaaaaaaanaaaaaaaaaaaaaanaacaaaanaaaaaaaaaaaaaaaaaaaaaaaaaaaaaaaanaaaannanacnagaaaaagagaanagaaagaacgagaacaagaaatgagataacaaaagaagcacacaacgaaaagaaaggaatggaggcggtgaagcgatatgtaaggtacaagatggaggacgagacgaggggcagtg

SEQ ID NO: 344406 - DNA, 3910 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatggagcctgagtcctgggccctgtgcctgcttcttttcctgggaacagccttgggctacccaccactcccaaggcattcttccaaatgtgaaatcctggaagtaagattgcaccttcttcctctcctgatcaacatcggtatgatgtctcctgttgcctcaccctttgtctgcagtatcactggataggactggtggaaagggagcagcctgacagagctccaaatgtggagaatatggcatccctccacctatatttgatgtggacggtaaggctaggcctgcaggatcccttatcctgaccaaagactgtgttggggtgccatttgaaaatcgcagggttgcaaaagaatacaatcttacttgcaggtggatattctctatactctcttttaatgcatctaaaaatcccaaacatcccctggttggtgatcacttacagttgtgtccacctttattttatgtactttgattaaaaaaaaaaaactttttgttaatataaaatgtttccaagaagaaaatttattctattgtattattttctcattatatatttttaaaaatatccttgggggggggcccgtcaccaaattcgccctatggggagtgcgatttacaattacttgggccgcgtttttag

SEQ ID NO: 344407 - DNA, 3410 bp, Homo sapiens
  misc_feature (3342)..(3342): n is a, c, g, or t
  misc_feature (3348)..(3348): n is a, c, g, or t
  misc_feature (3352)..(3352): n is a, c, g, or t
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatggaaaataaaataatacatgtctactttgtaaagtgtgtgcaatgtacagaactcgagggggggcccggnccccanttcnccctataggagaggcgattacaattaccgtggccggcttttacaacgtcgggactggg

SEQ ID NO: 344408 - DNA, 3167 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaacctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgga

SEQ ID NO: 344409 - DNA, 3143 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgga

SEQ ID NO: 344410 - DNA, 3335 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgagtgagtgtgcgcgcgccgttcgcttgctgcggcggcgcgcaccgggaccagccgcgcaggttcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgga

SEQ ID NO: 344411 - DNA, 2944 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttgtggggcgggagaaacaaagtttttttttttttttttaaaaacagattttcttttggaaaaaaaaa

SEQ ID NO: 344412 - DNA, 2916 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgga

SEQ ID NO: 344413 - DNA, 2688 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagaatcactttgaagaagccatgcgctttgcgcgccgttctgtcagtgacaatgacattcggaacatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatgga

SEQ ID NO: 344414 - DNA, 2224 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcaggatcaatgatgtcaggccggttggtagcgccaatgatgaacacattttttttttgtggacatgccatccatttctggttggatgttgattgg

SEQ ID NO: 344415 - DNA, 1845 bp, Homo sapiens
  misc_feature (1668)..(1669): n is a, c, g, or t
  misc_feature (1671)..(1671): n is a, c, g, or t
  misc_feature (1680)..(1680): n is a, c, g, or t
  misc_feature (1682)..(1682): n is a, c, g, or t
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggggctgagcnnantaaccatanantggggaacgggtaagtgccaggtacctgggagactcgggggcagaggagtcaggtgagcaggcggctttttgcgggcccgaatctgagtgggatgcctgggggaattgccgttttgttgcggccctagggggcgtggggcaaatgcccgtttgaggcgcaaag

SEQ ID NO: 344416 - DNA, 806 bp, Homo sapiens
ttacacaccaccacccacttacggctaggtacgaggctgggtgttgcgaaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaagggacttctggccggggggaggcgtggggcgtccagggggcacgatctaactttgctgtgcca

SEQ ID NO: 344417 - DNA, 1047 bp, Homo sapiens
  misc_feature (6)..(8): n is a, c, g, or t
  misc_feature (26)..(26): n is a, c, g, or t
ggagannnaagaactacggctaggtncgaggcctgggtgtcgcttccgtgctcccggcgagcgggcggagagcgggggccgcactggggagtgtgggctgggccgcagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagcccagactgttcactttggggcagggacgaacatgtgcctcgtgaatttgcttgaaaacagtcaccatcttctacccccatcactgtatagtgaaaaacctgattaaagtggtatctgagaaccataa

SEQ ID NO: 344418 - DNA, 2627 bp, Homo sapiens
cccaagatttcatgtaagacttaggttttactatatttgaattatttttacactaacaatagccacatttatttccctgctggctgtgtgcctgccacagtactttacaaatattatctcttccaaccctcacaccatccttgcgaaatgggtgttattacctctacacagaaggggaagggaggctcagacaggttaataatgttcccaaggtcactagaaagctagcccggatcccaagaggtcttaaagcactaaaatatactcttctaagaagagcttcttgaggtcagggatcatgtcttttgtttttgcgtgcccagacctaggtcttagaagacgcctaataaacatcagttgaaaaaaatgactggatgatctttcactttttccacgcagaaaacacgtggcgacatcactgagaaacctcccggccaacagagggcgcgacgtccatttcagcgcagtggggcccagttgcggacgcctagcttccttccgtcctttggctgaagttcagccaatccctgcgctccgagagagccggcggccagtgggcagggtcacagggcaaggtcccgcgggccgctgggtgcggcgacttccgtgctcccggcgagcgggcggagagcgggggccgcactggggagtgtgggctgggccgcaggtgagcgcgcggtcccggcgagcaggtcgggtcagcccaggccagtaacctctgagttacgggaggagtgatcgctagggtccaccccggtcccggccagatctgccagctcccctctctggcgggtgttctggtgccaagtctgggagcccaggtagccctccgcagacagggcttctcggcacctcaatgaggacggacgttgatgaggccatgaatgaggtgggctagggacaggggaccgggagactcacagaagggagaagggtagccatttggatggaccttcgccttacttgcgctcccattcctggactgcgctctagtgactgtcagggctaattcttccgccttctcaggcctcctgtgtccttgttagtagttcttgaatttgggactacggcttctggcctcgttgggcctccgggccctcgcactggggcaggtttcccagcagcccagttgacctttaccggatgcttttggcagacgtcctccatgccgggctggaaatatgcgtcacagtgtttttcagacacttttgcctctttcattgtgataccctgcctggggacgactatgatggagtctttagggttctggaatcagcaaaggcatctgttatgctcctgccaccttttgggggagagtgggtggaggatgttgtgattttacactagggagtttgggctgtcattcattcgttcagcagaccttttttgggcactctgccaggcagggtaggagaggtgcctggatggatagggcataattgggccagacagacacggttcttagccttttggagcttaaagtgtcttgagaaacgcagacagggaaaaggaacgacttttcatattgtgaaaccaggagattcatcgtagattgtgtttcatggggaaaaggtggccggctgtgctcatggagaaatttcatagagcagagaaaggcatctttttcccttcttgaaatgttggcagactaggtcctggggtcaacaataggcttgaagctctattagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagcccagactgttcactttggggcagggacgaacatgtgcctcgtgaatttgcttgaaaacagtcaccatcttctacccccatcactgtatagtgaaaaacctgattaaagtggtatctgagaaccataa

SEQ ID NO: 344419 - DNA, 1631 bp, Homo sapiens
cccaagatttcatgtaagacttaggttttactatatttgaattatttttacactaacaatagccacatttatttccctgctggctgtgtgcctgccacagtactttacaaatattatctcttccaaccctcacaccatccttgcgaaatgggtgttattacctctacacagaaggggaagggaggctcagacaggttaataatgttcccaaggtcactagaaagctagcccggatcccaagaggtcttaaagcactaaaatatactcttctaagaagagcttcttgaggtcagggatcatgtcttttgtttttgcgtgcccagacctaggtcttagaagacgcctaataaacatcagttgaaaaaaatgactggatgatctttcactttttccacgcagaaaacacgtggcgacatcactgagaaacctcccggccaacagagggcgcgacgtccatttcagcgcagtggggcccagttgcggacgcctagcttccttccgtcctttggctgaagttcagccaatccctgcgctccgagagagccggcggccagtgggcagggtcacagggcaaggtcccgcgggccgctgggtgcggcgacttccgtgctcccggcgagcgggcggagagcgggggccgcactggggagtgtgggctgggccgcaggtgagcgcgcggtcccggcgagcagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagcccagactgttcactttggggcagggacgaacatgtgcctcgtgaatttgcttgaaaacagtcaccatcttctacccccatcactgtatagtgaaaaacctgattaaagtggtatctgagaaccataa

SEQ ID NO: 344420 - DNA, 1828 bp, Homo sapiens
cccaagatttcatgtaagacttaggttttactatatttgaattatttttacactaacaatagccacatttatttccctgctggctgtgtgcctgccacagtactttacaaatattatctcttccaaccctcacaccatccttgcgaaatgggtgttattacctctacacagaaggggaagggaggctcagacaggttaataatgttcccaaggtcactagaaagctagcccggatcccaagaggtcttaaagcactaaaatatactcttctaagaagagcttcttgaggtcagggatcatgtcttttgtttttgcgtgcccagacctaggtcttagaagacgcctaataaacatcagttgaaaaaaatgactggatgatctttcactttttccacgcagaaaacacgtggcgacatcactgagaaacctcccggccaacagagggcgcgacgtccatttcagcgcagtggggcccagttgcggacgcctagcttccttccgtcctttggctgaagttcagccaatccctgcgctccgagagagccggcggccagtgggcagggtcacagggcaaggtcccgcgggccgctgggtgcggcgacttccgtgctcccggcgagcgggcggagagcgggggccgcactggggagtgtgggctgggccgcaggtgagcgcgcggtcccggcgagcaggtcgggtcagcccaggccagtaacctctgagttacgggaggagtgatcgctagggtccaccccggtcccggccagatctgccagctcccctctctggcgggtgttctggtgccaagtctgggagcccaggtagccctccgcagacagggcttctcggcacctcaatgaggacggacgttgatgaggccatgaatgagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagcccagactgttcactttggggcagggacgaacatgtgcctcgtgaatttgcttgaaaacagtcaccatcttctacccccatcactgtatagtgaaaaacctgattaaagtggtatctgagaaccataa

SEQ ID NO: 344421 - DNA, 1506 bp, Homo sapiens
cccaagatttcatgtaagacttaggttttactatatttgaattatttttacactaacaatagccacatttatttccctgctggctgtgtgcctgccacagtactttacaaatattatctcttccaaccctcacaccatccttgcgaaatgggtgttattacctctacacagaaggggaagggaggctcagacaggttaataatgttcccaaggtcactagaaagctagcccggatcccaagaggtcttaaagcactaaaatatactcttctaagaagagcttcttgaggtcagggatcatgtcttttgtttttgcgtgcccagacctaggtcttagaagacgcctaataaacatcagttgaaaaaaatgactggatgatctttcactttttccacgcagaaaacacgtggcgacatcactgagaaacctcccggccaacagagggcgcgacgtccatttcagcgcagtggggcccagttgcggacgcctagcttccttccgtcctttggctgaagttcagccaatccctgcgctccgagagagccggcggccagtgggcagggtcacagggcaaggtcccgcgggccgctgggtgcggcgacttccgtgctcccggcgagcgggcggagagcgggggccgcactggggagtgtgggctgggccgcagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacacccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagcccagactgttcactttggggcagggacgaacatgtgcctcgtgaatttgcttgaaaacagtcaccatcttctacccccatcactgtatagtgaaaaacctgattaaagtggtatctgagaaccataa

SEQ ID NO: 344422 - DNA, 710 bp, Homo sapiens
agcaaaggcatctgttatgctcctgccaccttttgggggagagtgggtggaggatgttgtgattttacactagggagtttgggctgtcattcattcgttcagcagaccttttttgggcactctgccaggcagggtaggagaggtgcctggatggatagggcataattgggccagacagacacggttcttagccttttggagcttaaagtgtcttgagaaacgcagacagggtaagccagcatcgtgcctgacacagagtaagtggttataagtgtcgaataaaggaatgaattgacttatttgggaatgattagaatgtgagcaggacggtagcgagagactttatgctgcatgtgagagatagttgtgaactcatgcgcgatatgttttaagacaggtttggaaatctgaacggacagttgctatttagggaagcatttacttatacagaggacttgctttaaaggtggaagtaaaatggagaagtattaggtttgggattcttcagaggtgcctcttttaactattactatgtctctgaatttcataaatccctgagtacaatctcagagtttgggaaaaggaaagctcttctaggtaatgaaatgccaggctgatgggaaaaaactgtaggaagctctccctaagtccagggtttggacagaaaccgtatacctctgcagtgtgttcttcccactagaaagagtgta

SEQ ID NO: 344423 - DNA, 1606 bp, Homo sapiens
cccaagatttcatgtaagacttaggttttactatatttgaattatttttacactaacaatagccacatttatttccctgctggctgtgtgcctgccacagtactttacaaatattatctcttccaaccctcacaccatccttgcgaaatgggtgttattacctctacacagaaggggaagggaggctcagacaggttaataatgttcccaaggtcactagaaagctagcccggatcccaagaggtcttaaagcactaaaatatactcttctaagaagagcttcttgaggtcagggatcatgtcttttgtttttgcgtgcccagacctaggtcttagaagacgcctaataaacatcagttgaaaaaaatgactggatgatctttcactttttccacgcagaaaacacgtggcgacatcactgagaaacctcccggccaacagagggcgcgacgtccatttcagcgcagtggggcccagttgcggacgcctagcttccttccgtcctttggctgaagttcagccaatccctgcgctccgagagagccggcggccagtgggcagggtcacagggcaaggtcccgcgggccgctgggtgcggcgacttccgtgctcccggcgagcgggcggagagcgggggccgcactggggagtgtgggctgggccgcagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagcccagactgttcactttggggcagggacgaacatgtgcctcgtgaatttgcttgaaaacagtcaccatcttctacccccatcactgtatagtgaaaaacctgattaaagtggtatctgagaaccataa

SEQ ID NO: 344424 - DNA, 1727 bp, Homo sapiens
cccaagatttcatgtaagacttaggttttactatatttgaattatttttacactaacaatagccacatttatttccctgctggctgtgtgcctgccacagtactttacaaatattatctcttccaaccctcacaccatccttgcgaaatgggtgttattacctctacacagaaggggaagggaggctcagacaggttaataatgttcccaaggtcactagaaagctagcccggatcccaagaggtcttaaagcactaaaatatactcttctaagaagagcttcttgaggtcagggatcatgtcttttgtttttgcgtgcccagacctaggtcttagaagacgcctaataaacatcagttgaaaaaaatgactggatgatctttcactttttccacgcagaaaacacgtggcgacatcactgagaaacctcccggccaacagagggcgcgacgtccatttcagcgcagtggggcccagttgcggacgcctagcttccttccgtcctttggctgaagttcagccaatccctgcgctccgagagagccggcggccagtgggcagggtcacagggcaaggtcccgcgggccgctgggtgcggcgacttccgtgctcccggcgagcgggcggagagcgggggccgcactggggagtgtgggctgggccgcagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagcccagactgttcactttggggcagggacgaacatgtgcctcgtgaatttgcttgaaaacagtcaccatcttctacccccatcactgtatagtgaaaaacctgattaaagtggtatctgagaaccataaaaaaaaaaaagagacacagacgaagaaagacaaagaacgacagaaggcaaacaaaaacaaaagaaagatagagacgagagggagggagacaaagagagaagagggacaccacacacaaaac

SEQ ID NO: 344425 - DNA, 2610 bp, Homo sapiens
cccaagatttcatgtaagacttaggttttactatatttgaattatttttacactaacaatagccacatttatttccctgctggctgtgtgcctgccacagtactttacaaatattatctcttccaaccctcacaccatccttgcgaaatgggtgttattacctctacacagaaggggaagggaggctcagacaggttaataatgttcccaaggtcactagaaagctagcccggatcccaagaggtcttaaagcactaaaatatactcttctaagaagagcttcttgaggtcagggatcatgtcttttgtttttgcgtgcccagacctaggtcttagaagacgcctaataaacatcagttgaaaaaaatgactggatgatctttcactttttccacgcagaaaacacgtggcgacatcactgagaaacctcccggccaacagagggcgcgacgtccatttcagcgcagtggggcccagttgcggacgcctagcttccttccgtcctttggctgaagttcagccaatccctgcgctccgagagagccggcggccagtgggcagggtcacagggcaaggtcccgcgggccgctgggtgcggcgacttccgtgctcccggcgagcgggcggagagcgggggccgcactggggagtgtgggctgggccgcagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagcccagactgttcactttggggcagggacgaacatgtgcctcgtgaatttgcttgaaaacagtcaccatcttctacccccatcactgtatagtgaaaaacctgattaaagtggtatctgagaaccataaataatgatcgaatcttatcatccaggtggtatttgggggtcttcttaggagttaggcaagtacaggcattttagagcaggataacattggtattaaagggtgccaaggagccctggaaactgctttactagtgcggttgcactgaaccctggaggcacagattcccaggaacctttttaccattattacaattggctgcagcaccttcaagtctaaatggaggtagacctcacatacacacacatagacgcctttccctataaaagtatatacgcacattcaagaaaatttggtagggattttaaaaaggtcacccatgttcccagctcgttaataacaaccgttaacattttgttgtcttttactaattctctgcataggttttagagatagttatcattactgtacatttaattttatatacttttctcactattatcattttcccattttacatggtcatcataattggttttttggagacagggtctcactctgtcacacaggctggagtgcagtacaattacggctcagtgcaaccttgacctcctgggctcaagtgatcctctcacttcagctcctcaagtagatgggactacaggagtatgccaccatgcccagctaatttttttatttttttgtagaaccaggtctcactatgttgcccaggctagtctcaaactcctgggctcaagtgatcctccggccttggcctgtagtttcttttttctttttttttggagatggactctcattctgtcacccgggctggagtgcagtggcgtgatcttggctgactgcaacttctgcctcctgggttcaagcgattctcctacctcagcttcctaagtagctgggattacaggcgtgcgccatcgtgcctggctagtttttgtgtttttagtaaagacaggggtttcaccatcttggccaggctggtctcgaactcctgacctcaagcgatcccatctgcctcggcctcccaaagtgctgggattacaggt

SEQ ID NO: 344426 - DNA, 2004 bp, Homo sapiens
cccaagatttcatgtaagacttaggttttactatatttgaattatttttacactaacaatagccacatttatttccctgctggctgtgtgcctgccacagtactttacaaatattatctcttccaaccctcacaccatccttgcgaaatgggtgttattacctctacacagaaggggaagggaggctcagacaggttaataatgttcccaaggtcactagaaagctagcccggatcccaagaggtcttaaagcactaaaatatactcttctaagaagagcttcttgaggtcagggatcatgtcttttgtttttgcgtgcccagacctaggtcttagaagacgcctaataaacatcagttgaaaaaaatgactggatgatctttcactttttccacgcagaaaacacgtggcgacatcactgagaaacctcccggccaacagagggcgcgacgtccatttcagcgcagtggggcccagttgcggacgcctagcttccttccgtcctttggctgaagttcagccaatccctgcgctccgagagagccggcggccagtgggcagggtcacagggcaaggtcccgcgggccgctgggtgcggcgacttccgtgctcccggcgagcgggcggagagcgggggccgcactggggagtgtgggctgggccgcagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagcccagactgttcactttggggcagggacgaacatgtgcctcgtgaatttgcttgaaaacagtcaccatcttctacccccatcactgtatagtgaaaaacctgattaaagtggtatctgagaaccataagaaaaaaaaaaaaaaaaaaaaaaaaaaaaacacctttttggcgccggcgccttcgggccctcctcgaaaaagcgttttttagacccaattctcgtttgggcgcgcgcggggccccatgtgggttaggggcacctgggccaaatcggcgggttccccagaggaaaaaccggcgggccacatggacacatagagggtggtcgggggtattttctccaaccaaatataaaaaaagacgccccgcgggggaaacacggagaggctttctgtgataacacatattccccagagaggggggatttttccgagggaggctccataagacggggcgatctcctttatcaaccgcaggggagttccacagaggggaaggctcgcgaattatttcacaatattagccc

SEQ ID NO: 344427 - DNA, 480 bp, Homo sapiens
ccgctattcaaacctagaagttcagatggaatactcctatcagtaaactgttttgaggtctcataaaagaaactatcacttaaggagccaggactgctgctttatttttgttctcaatcgactttacacatgtaactttgcaaccagtttgcctttccttgctgctagagctacatttgcatcttttggagagtctccttatttggtcccagttccctatggcctctgatctgccactctgccttgctggtaatccaattatcattcttcctatatgcttagaactgatctaatgcctatctgctgaattgtactatctgccagacagacaccagaagagtaggcatggggagagaggccaagaaaaagtagactgtggtatggtacacatgacatgactcatctgttctaactgttccataacctgtcctgaccaagtggctcagataatactgcctggctcactctggcagacttgtt

SEQ ID NO: 344428 - DNA, 439 bp, Homo sapiens
ctcccaaactgttgggattacaggcatgagccaccatacctagccccctttgcccatttttaaattgagttgttttccgttgctgagttttaggagttttttaaatcattctggacattaatcctttagcagataaatggcttgcaaatatttcctcccattctgtgagctgcctttttattcttttgatagtgccctttgatgcacaaaagttttaaattctcatgaagtccattttgtctatttttttcttttgttgtctgcacttttgatgtcagacccaataaatgattgccacatcgattttttttcttttttctttttcttttttttttttttcagaagaatcgcttgaactcgggagtcggaggttgtggtgacctgagatcgcatcattgcactccagcctgggaaacaagagtaagactcagtctcaaaa

SEQ ID NO: 344429 - DNA, 540 bp, Homo sapiens
agtttttattcgggggtgtagcatcatctgaattatattttaaaagatcatgctgactgctgtatgagcaaaaagaatactgggggcaagtggaagcagatacgctagtggatatgcaacagtccaggcagcagacagcaatggcttagattagcgaggtggcagtaggatagagagcagtggacatctgtgagaattttttaggtggtagaaatacgaaggcataaatagggttggatatggaacataagggaggggaaagaactcaaggatgttgctggaagttgccactattggatggttggaagaggagtggattttgggggggattgtttcgtgggagaggtaagggtgaattcagcagttccccttttgtctatcttagttctcagaagcctgtaagattgtcaagtaggcctgttagagagatctatacatcttgaggaattcagagatacttggcttagagatgtcagtttgaagattgtcactatgttagtgatacttaaggtaatgaaataattgaagaaaagattataa

SEQ ID NO: 344430 - DNA, 930 bp, Homo sapiens
tggttcatgggacggtctcctaacataatgtttatatcccgtggctcaggcatagagacccactcatggtttcccatcagaatttgggttccagttcaccactccacatacacacaccaaggctaatgattcatgctattgtcagtttttgcttctttgatattgttctgaaggtagtttttattgatacttctttctttctaaagtcaatgagtaaagttatggcaagacattggaaagacattgcagtgctcccaggctggagtgcatgactcatctcctggcccctccaggaaaccggagaaggcagaaaagggcaagaatgttgtgttgtctttgggctgtggagttcatgattatggacactttctgaattattggcactaagggcacatcctgcttagcatggaggctggacagctctgggaaagcagagattctttttagggagtccagagcatttttttcttctttcttatcccctctttccaatagagatgtcagaagggtgactgttagggttgatacattatgtggtgctctgtttttttgagcattgtctactcagagtgattaccaaggtggagctcattatgttacctggcacctgcaactacttgcctcatgttggactaaagtggaaagactcctattgggaattcactcagggaggcaccaggcattgttagaaaagcagtatcgcagagcacttaagagctgagccttgtgatcaggtggacttgggtttatgtcctcgcactgtcgcttcctagatttatgacctcagtttcctcatttctaaagtagagacagggatggagggtggggagaatatgaattaatttggattaaatggatgagaatcagaagtatttatttggaattggtgtgaacttggagcacatggggaactgaaaacaaaggtgataa

SEQ ID NO: 344431 - DNA, 719 bp, Homo sapiens
agacaaggtctcactttgtcaccaggttggagtgcagtagtatgatcacaactcactgcagactcgaactcctgggctcaagggatcctccctcctcagcctcccaagtggctgggactacaagcacgcaccaacacacctggctgatttaaaaatttttgtacaaatgggatctcactatgttgcctatgctggtcttgaacacctaggcccaacgatcctccagcctcgccttctaaagtgttgggattccaagagtgagccatggtgtctggcctcaaaaatctttaatacctttatagagttgtgcaatcatcaccacaatccagttttgagacatttccattactccaaaaagatcattcatgccatttgcagttaaccaccactcccatctccaacctcagctactgttgatcttgctgtttgcacagatttgcctttatgggaagtttcatataaaaagaatcaaacaatatgtggccttttgcatctggcttctttcacttaatgcttttgaggcgtatgcatgttgtagtgagtatcaggtgtacgtcatgtatacgcaggaatatctgtccctttgctgtcggggaggacgccatcgcatggaggtcctgcattttgtttttctgtttctcagttgacggtcatgtggattgtttacaggtctgggctattatgaataatgccactatgaacatctgtgtccaggtttc

SEQ ID NO: 344432 - DNA, 456 bp, Homo sapiens
aatcagggtttcgccatgttggccaggctggtttcggactcctgacctcaggtgatctgcccacctccacctctcagactgctgggattacaggtgtgagccactgcacctggctgaagggtcctattcttttatccacatgaaggaggtttttaggagtgatggttgctcttaaactattcatcatgatactggacttttcaaagtactcagtgggtttgcttacagctttctataggtagctgtccccactaaatggattctcagacaaaacaaacaaatctatgacattaagcccttggtaagtgtcaggcattgtgttgggtgttgaggatgaaataggatggttcttcctgctttagatgattataaacaggtaattagaataaagcatggtaggtgttctgcagttgagaataaggtatgaaggaactcaggactggcctgttgctactt

SEQ ID NO: 344433 - DNA, 402 bp, Homo sapiens
gctagaatgcccagtaggagtgcagactggaggatcggctgttttttgaactggagacatcacaggaaactggggaggctccaaattgctaacctgaggccggagcaaaaactttttttttgtcgaagggactgctttttttatttccccttcaacggatggcatcccaagtcctgctggattgcatctgtctttgttcctgcagccaagccttatagctggctcacactctgccatgctcataacctcacactagaaaggatattacaaagaggggcaaacaccctagagggttcccctttatcagaaccttccctgtcagtgggctcctcatttcccgagccctcgtctgattattagtgtactgacggaataaaaataacctcatattcctacatgaat

SEQ ID NO: 344434 - DNA, 563 bp, Homo sapiens
attaaaaaaaaaatctttactcactctttccaggcaacaaaatcctcttcccagttctgttacataataggaatgatgtttgccacttgcaaacaggcagccaaattatattttgccatttgcatgtaacctcttggacagaatggcttttattggtgtaaagttccattcagaactctctagttcctgagtttctacggtggaggggttaagggtgcatgttctagagtcacgacaaactggacttgatttccagcttcatctcaggacttgggcagcctgttttaccttttaattcctcagtttcttcatctgtaaagtggatcaggtattagaactggaatgaagttggcagggtgcagtggtttatgcctgtaatccaagcactttgggaggccgaggcaggcagatggcttgagaccgagtttgagaccagcttggccaacatatggaaatcctgtctctactaaaaatataaaaattagccaggcgtggtggcgtgtgcctgtagtcccagctactccagaggctgaggcacgagaatcacttgatcccgggaggca

SEQ ID NO: 344435 - DNA, 771 bp, Homo sapiens
tgtttagactttagaggtggcttgcaattacaattttattattaaaataagacttattaaaataagagagaaaacatgtatctttggtaatgtgaaaagaagaagaattcgcagcttattcttctcatatcataaagttttttccacctacaagataccacagtgtctcacatggaacccttacagagttactccttttggttaaaacatttgcctttatcccagcactttgggaggccgaggcaggcggatcacgaggtcaggaaatcaagaccttcctggctaacaaggtgaaacctcgtctctactaaaaatacaaaagttagccgggcgtggtggcgggcacctgtagtcccagctatccgggaagctgaggcagcagaatggcgtgaacccgggaggcggagcttgcggtgaggcggagcttgcagggaggcggagcttgcggtgaggcggagcttgcggtgaggcggagcttgcggtgagccgagattgcgccactgcactccagcctgggcgacagagtgagactccatatcaacaaaacaaaacaaaacaaaatttacctttgaatccgtctcaaaagtgaaggtccagcctagcagagtgccagacatcatgagtctttagaattctaaggagcagcatgagaattctcaggccaaagcctgatttctcaactccagcaaatgtgcatttggtgtttcacgctgagtactgtatgtgtattctgcatgtcccttccagcaaatacacatttggtgtttcatg

SEQ ID NO: 344436 - DNA, 491 bp, Homo sapiens
cttttctaaggcatattaaatggtttctttaaaatcacagtataaatgagtaaattaattgacttggatttaaaagatgttttctgttgatagtacttcccagtatgttagctcaataaatgaaagagagatgctgccaatcagagacgttcccctttaattaaataaaaggaatgtattcaagtatttctaaagatgaaataaaggaaaataaaaacataataagcattaacatggcctatgtgccctgcttcttagataggctcttaatcaaacaagaccacaataaaatatgccattacattatcatgttcagtattagaaacaagaattttcatgtacaaaacatgcttctattacggacacaataatttgttcaacagcagaaatactctgaattccccaagatcaacacaattaaaatgacaataacggtcaacaattaaaaagcacttcatgctgcacaaagatttttcatatttatgatcttg

SEQ ID NO: 344437 - DNA, 512 bp, Homo sapiens
aatttccagagggctagtagcaagaagatggctgagtatagcccttggattccaggttaagggttgggtggctctaaggtactagagatcttgaggtcaagagcaactgtattgggaataaattcggagggcagaaagttaaaaggataggggctacagtcacatagcagcagatttatccagcccttggtgccctgctgttgtccttttcttcacccaactctattgatccagccacccatcatgtccatgtctacactcaggtttctgagcaagaaggagaacattccacagtcatgtgcattggtgtccaactgtctctgtctcctcactttgtgcatgtttctcaacagcgtccccaccctttcctcaccatgacttcaccatcactttttcagttgctgtctctgctcccatccccacaaatatagacatattcatagacataaaatttctttcatagatagtgccatactgggagcattgtcctatgagttttttacttaacactc

SEQ ID NO: 344438 - DNA, 513 bp, Homo sapiens
caaaaaaaaaaaaaagaaaagaaaagaaaaaaaagaaaaagcccacactcttactaggttagcacggaggggcgggcgccttggcactcagatcttacggtcgcagagcataattgcccaaccaaccgcccaaagaaaaataacaagcggcggggggttggggagggaggagggccgacgtggaccacctctggcttagctcaaaccccctgaaatctcgcaaacgcagctagcactcaggctcgagctcctcccggttcccactgacacagagggacccccagactccggaggtggggggtccgagagtaaaaataatgggcagatgatcgtcgcatcctctgggctcctcgtggaacgtcagtgctggccagtggcttctgtccggatgctcagtagcaaactttaggcaagctcccctgagggagtggtggcggtgcaggctctctccttcccttgttcgttcgtcagacctgctgctgcagactccagagacgctttgctctctagtgg

SEQ ID NO: 344439 - DNA, 402 bp, Homo sapiens
aagaaaagaaggaacaatggtcgtgccaaaaagggccgcggccacgtgcagcctattcgctgcactaactgtgcccgatgcgtgcccaaggacaacgccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccacctcgatttagacctgcgggtgctgccccacgtcccccaccaaagcccatgtaaggagctgagttcttaaagactgaagacaggctattctctggagaaaaataaaatggaaat

SEQ ID NO: 344440 - DNA, 114 bp, Homo sapiens
ccgcctactactactactgctcgaattcaagcttctaacgatgtacggggataaggagctgagttcttaaagactgaagacaggctattctctggagaaaaataaaatggaaat

SEQ ID NO: 344441 - DNA, 496 bp, Homo sapiens
ggttcaacctgcaggctcgaaaacgcaaaggtctttaaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaagtaaggagctgagttcttaaagactgaagacaggctattctctggagaaaaataaaatggaaat

SEQ ID NO: 344442 - DNA, 316 bp, Homo sapiens
ggccggtgcgtttggggtgctcagtaaacatttctggcataaattagtagtctcccgcatcatccttaccacaggccatgattcatgtatgatattgctgtttttgatatcagcatccatgtagaagccagtgggtcaaatagaaccaggcagaattgaatgattgagtcggaaatgcagagcatcaagccagcacccaccgccacacagattgtcactggtggttgtcgggctatgaacagagttgggcctttgtcttggcccctctgggctattattacttatttatttattttttagagatagggtctcactc

SEQ ID NO: 344443 - DNA, 182 bp, Homo sapiens
tgcctgtaggtacctggtgccatggggagcagtagatacaacagtggacagaggagatgtggccccgccctcatggagttgatcggccttgtccaaactacataaacaggtcactgtaaaactttaattttacttttaaaccagaggcataggctgcacgtgtacagtgtgcaaactaagtt

SEQ ID NO: 344444 - DNA, 233 bp, Homo sapiens
ctttgattatggccttttggctccagaactgtgagaaaataaatttctgttgtttttagccaccaagttcatggtactttgttactatagtcataagaaacaaacacaactactttccaatattttcattttcatttatgatttacaaattactttaccttcgacaaaagattccccttattgaatatctcttctccttcagttttatgtttttttttttttttttttttttt

SEQ ID NO: 344445 - DNA, 1664 bp, Homo sapiens
acatatgcctgtattttcctttgtaacttctgactagtacagcagagcttttgtatgtgctagttagccaataaatgctgtccactgttaatataaaattctaaaatctggcctagaattaatactaatgtaagtcacgtattcattaccaagaaattcatgaaaaacaaatggtgtgttttaaaatttcaataaataagactttcaaaggaatagtttcattcataacaagcattctgccctgaatgcagtaattctggaggccactgtcttagtctgttctcaatgctgctataaagaaatatctgagactgggtaatttataaaggaaaaaggtttaattgactcacagttctgcattgctaggtaggcctcaggaaacttataatcatggcagaaggcaaaggagaagcaggcaccttcctcacagggtggcgggatggagtgagtacaagtgggggaaatgccaaatgcttataaaaccatcagatcttgtgagactcactgactatcacgagaacagcatgggggaaattacgtccatctggccccacccttgacacgtggggattctggggattgctgttcaagatgagattttggggacacagccaaacaatatcaggcacagaaggggaccaaatcagcctggagtttagcacatttcatgtgagtctgtatcatagtttgaattaaatagaaagggattcagtgtatttttgagaacctatgttgtgtgaggaactagaaagagaaatgactacatgtaatgatgaccatcacagaggagctacagaagccagcataaggtggtggtttgtggagatggggaatagttgactcctggtgctgggaattgcaagtgcaatggcatagaggtgtgaacagcacactaggtctgggagcatagggtgacaccgagtcactggggaagagatgtgactagagaaattggccttcatgccattcaggaaaaaaattggactttatctcatagactgcatgtgtgggttgggggcaaaaggaggtggggagctttgaggctttaaagtaaggaaataatgtcaaactcacactatcttttccatggcagtggaggaggcaaaagttggagtagtgagtgggcaaggctggatacacttgcagaggtctgcgtaggagtagaggaggcccagatagtatggtggtgataggaatagagaggagagatggattcgagagcttcctgagataacaaggtatgaggggggatcaggaagagggagtgggtgggaggctcctttgggatgacctgtaagattttggcttagatgactgaggaagcagcagatgcagatgaagcagcccttgctggcctgttgagttcagggagcttcctgaagagtgaaaagaaggtcagtagacactgaggttgatgactctagacctagaggcaagagtctgggccatgatgagcctctgactggcgttaatatggagctgggaggtgaaaaccacagtgccttggagtgctctcggaaggcacatctgtctttcagaggaaagactctcactgaggccagaagcttgaaaagcgcccatttgggataagcgggagaataggggcagcagagaacgtctacagaaagggcgctcttggggagcgagctacatactgattccat

SEQ ID NO: 344446 - DNA, 1590 bp, Homo sapiens
acatatgcctgtattttcctttgtaacttctgactagtacagcagagcttttgtatgtgctagttagccaataaatgctgtccactgttaatataaaattctaaaatctggcctagaattaatactaatgtaagtcacgtattcattaccaagaaattcatgaaaaacaaatggtgtgttttaaaatttcaataaataagactttcaaaggaatagtttcattcataacaagcattctgccctgaatgcagtaattctggaggccactgtcttagtctgttctcaatgctgctataaagaaatatctgagactgggtaatttataaaggaaaaaggtttaattgactcacagttctgcattgctaggtaggcctcaggaaacttataatcatggcagaaggcaaaggagaagcaggcaccttcctcacagggtggcgggatggagtgagtacaagtgggggaaatgccaaatgcttataaaaccatcagatcttgtgagactcactgactatcacgagaacagcatgggggaaattacgtccatctggccccacccttgacacgtggggattctggggattgctgttcaagatgagattttggggacacagccaaacaatatcaggcacagaaggggaccaaatcagcctggagtttagcacatttcatgtgagtctgtatcatagtttgaattaaatagaaagggattcagtgtatttttgagaacctatgttgtgtgaggaactagaaagagaaatgactacatgtaatgatgaccatcacagaggagctacagaagccagcataaggtggtggtttgtggagatggggaatagttgactcctggtgctgggaattgcaagtgcaatggcatagaggtgtgaacagcacactaggtctgggagcatagggtgacaccgagtcactggggaagagatgtgactagagaaattggccttcatgccattcaggaaaaaaattggactttatctcatagactgcatgtgtgggttgggggcaaaaggaggtggggagctttgaggctttaaagtaaggaaataatgtcaaactcacactatcttttccatggcagtggaggaggcaaaagttggagtagtgagtgggcaaggctggatacacttgcagaggtctgcgtaggagtagaggaggcccagatagtatggtggtgataggaatagagaggagagatggattcgagagcttcctgagataacaaggtatgaggggggatcaggaagagggagtgggtgggaggctcctttgggatgacctgtaagattttggcttagatgactgaggaagcagcagatgcagatcccactccccacgctgtcctacggcgttcagggccctgcttgcagactgacaagtcgactccttaaacatctgcccttgcggacgtgagatctcgacgctagactttgcatctggatatacgtttgaccgactctaatatgtgagatgagtatggataaccacgcacccagagtattcacgacacggcacaactgtcttacaagagtaagagtatccatgaccgccagaccgtcaatagcgccctaggtgcag

SEQ ID NO: 344447 - DNA, 381 bp, Homo sapiens
  misc_feature (35)..(35): n is a, c, g, or t
taactgtatatgattatgtccctgattatgcgagngcgcccgccggttcagggtcccggagagaacaaaatcagagaggtaactatgtcaagctatctgctggagctgggacacattcttcctctcctgtccttggacaacaactccaggctccccagccttcaaactccaggacttctcccctctcctccacccttcctggcttctcaggcctttggccttgaactgagagctacaccatcagattccctgattctgaggccttcgggacttgaattgagccatactaccagcctcccagggtctccagtctgcagacgacctgttttgggacttcttgccaatttccctaataaataaactccatttcgtctttcaatc

SEQ ID NO: 344448 - DNA, 457 bp, Homo sapiens
gtctcactctgtcaccgtgtcacccaggttggagtgcaatggctcaatctcagctcactgtaacctccacctcccaggctcaagtgataactcctacctcagcctatgaagtagctagggactgcagggtcccggagagaacaaaatcagagaggtaactatgtcaagctatctgctggagctgggacacattcttcctctcctgtccttggacaacaactccaggctccccagccttcaaactccaggacttctcccctctcctccacccttcctggcttctcaggcctttggccttgaactgagagctacaccatcagattccctgattctgaggccttcgggacttgaattgagccatactaccagcctcccagggtctccagtctgcagacgacctgttttgggacttcttgccaatttccctaataaataaactccatttcgtctttcaatc

SEQ ID NO: 344449 - DNA, 370 bp, Homo sapiens
ataacttatcccaatacaccacctaactcttaactatatttctttgggtaacggaggaacaattctggtaactatgtcaagctatctgctggagctgggacacattcttcctctcctgtccttggacaacaactccaggctccccagccttcaaactccaggacttctcccctctcctccacccttcctggcttctcaggcctttggccttgaactgagagctacaccatcagattccctgattctgaggccttcgggacttgaattgagccatactaccagcctcccagggtctccagtctgcagacgacctgttttgggacttcttgccaatttccctaataaataaactccatttcgtctttcaatc

SEQ ID NO: 344450 - DNA, 620 bp, Homo sapiens
gtgtcagtgagaattgagcaactgagaagaagttagaggttagttcccttttccaagtatgatggattaaccacatgcaccccgtctttctcactgaatgcatctataaaacctaggcaaaatggatggaactcttctggactctgcagaataaataataccaggtgggatatgaatgaagactagcattcagaataccatctcactggctgtgagtttaccattttttttttcttccagcatccccagacaacttaacacaatctaaaacctaaaagtggggcaatctgaaacagaaagctctaaaagacgcctgctacttctggctcaaggaacaggaaagataactgctaagttcagaatgaaaattttgtcattttttttgtcttctccatctctcatgccctattcccaagcaaccgtgtggtaatggcagcagagactacagcaggagcccatggtcaaaactgagggatgagaactttcctctccagttgacaaatcccattgctttttctttttccttcttcatctctttgttcttccatttcttgtttccaagtcagatacagtatcagaagtgtgacccaagaagagtaccaaagatgcagcattctgga

SEQ ID NO: 344451 - DNA, 440 bp, Homo sapiens
cgcgcctggccacaaaaagatgtttttatttccctcaatccaaagaaatcttgttttattgagctgctacattaaaccatatgtacttttcctgcataccatctttcatatgcaatttgttttatcagtctcctccactagaatgaaaactccatacaggcaaggaccatgtctgttttgctcattagaacgtccctaggactgtgcttggctcatagtaggtgctcaagaatgaatcaatgtatcaaataaatatacaaggcttaatgggccatgatttaaagtggccctgaacctcaacttgccctaatgattttgaattacattgctatatatagcaacaaatatttattgagctgtgacttagagaaccagagtcaactgacttagacagtccccgctttgccgtttactagtagtgaccttgagattgtcactta

SEQ ID NO: 344452 - DNA, 379 bp, Homo sapiens
caggcatgtgccaccatgcctggctaatttttgtatttttaatagcgacagggtttcactgtattggccaggctggtctcaaactcctgacctcaagtgatccacccacctcggcctcccaaagtgctgggattacaggcatgagctaccacgccgtgccaactacatcttattcttgtttatttttcactttctctatctaactcagtgcaggatacctagtaaaattgtttcttcatcagagcgtttgagaattcagagttgcttttttttatgtgaactgatttagacatttagagacattgtacactaagaaaatgactcagaaaatagaacatctatatggctatcttgatgtatcctcattaatatgtggtgt

SEQ ID NO: 344453 - DNA, 453 bp, Homo sapiens
tgtcctcaacttctttcatcagaattttgtagttttccttgagtaggtctttcatctccttgaatacatttatttctaggtaatttttgtagctattgaaaaatgagattaccttcttcatttctttttcaaccagtttatgattagtatataacactactgatttttgtatgttggtttttgtatccttcaactttactgaatttatttatcaaatctaagagtttttggtggagtctttagctctttctgtaatagaaataagatcatgtcatctccaaacagggataattttacttccattttttcaatttggaatgccttttctttctttctcttacctgattgttctggctatgtctgccagtactgtgttgagtaggagagataaaagtggatatccttgttttgttccagttcttagagaaaagattttccagtttttcccattgt

SEQ ID NO: 344454 - DNA, 520 bp, Homo sapiens
tctttattctatactacaagccaggaaaattggttggaaatgacttactttttttccaactggtaaaaatagctttgcctaagtgctgcagaattttagtcgaagaaaaacataaactagaaatgcatgtgaatttttaaatatgaaagccaacatattgtctgtcattcattactatattagtaagaatcataggagattgttctaataatacaaatatctaacaatattaaatgattcctattcccactgaaggttaactattatatcaactttataatcatacttgacaattcattcttaagtagtgcataatcaaaatatctaaaataacatacaccaaaatactagtcaaaatcatattttaaattttagtaatatgcaattttaaaatatattaacagagtcaacagtaagtctgcattgcttggtttgaatagataacacccttagttttaataaactactataaatgcttgttattgaagggataccattttattatgaaaccagttattgt

SEQ ID NO: 344455 - DNA, 483 bp, Homo sapiens
tacatagcatctccctttttctgcttctggagtgaacatatgtatttatgcctgacagacttctaggtatatgaagatgattattctttttcttttaaattttttgttttttttttgggctgactgtacctattacttcaactgttctttaatataacatgatatctggtcccctccttccctggtctgccttctctggatatgttctattttatcccttttgaaaagcatagtatccagttctgagtgttaatctcttagtaaccatcttagcctaaaaccttctactctttactggtattaattcagccaaccccattgtcatattgattcatattgtttttgaaatttttagttctttttttaaacttacgattttattgaattaaattatttaatcatcatgtacttgttttgaatttttttgagcttgagatattctgtttattcattataaattttatcttaaagttagatttggcc

SEQ ID NO: 344456 - DNA, 244 bp, Homo sapiens
actaaccagaaccagatacagagaccagaagtatcagtaggaagaacagaacaagaatctgttcattcaacattttgtcctggctttttctggatgctgaggattcagtgataacaaagaaaaatctatgtctccactggaacttatattattgtggaatacaagaaataaaaattttatgttttcaagtaatttgttcattcatcaaacattaagaaaataaatgaatatatcctttgtgtca

SEQ ID NO: 344457 - DNA, 806 bp, Homo sapiens
gaactcctaaagaagaaatcatccattcagtgagagcaaatgaacactccaacagactgaaacaaagcatctttacaggagatgtgaatgcgagaaagcaaagagaactacagtcagggtctccgctggcatggcccaagcccaccgtggcatgatccagagagacgagtcagcagagcactatgggcagctcccatactcttcgcagatcaacaagccagcatataacccagggagatagataatagtgatgctgtgctctgtagagggtagtggcaacagtgggatttcttctggaataaatctgtagtgagccagatgtttctgctgactatattacttctgacagtgtataatccaaaattgtttccttggccttccaaaaagttttataagctccctaacggctgcaataaatccctttcttcttaaactagctagagtggatttttgttctctacaaaacagatcctgccactaagaaccccactagtatttgttgccatgattagggaataagttaaaccactgtaaggggggaaaagcagctccaagtacaagggcttaaatgtgttagaagcttctttctcatatcacaattcaagatgaatacctgggccatgctccataaagtcatctagatacccaggttgctggggcaactctgccatcttctacatttggcttttctctctaggtcaaaagtgttttctccagtgatcattaacttcactggttccacattccaggccacagaacggaacaaaagaaaatatgaagggcaaacaactttattttgaaaaacg

SEQ ID NO: 344458 - DNA, 478 bp, Homo sapiens
ctttctttttcattttctaaaaggttgatttgaagaaaccagtacctattctgaggttattattaaacatatacataccaccatataaatattcctttaaagaaagaacaagaatatgagttttgctgattggagtagttgaggtttgctaaatagcttctccaacatgatgtgctagaatcagatctttcttcttagatttatttaatctctgtgagcctcagtttcttgtttgttacattcagagaactcacaaaacatatagatgtgagaattaaatagtatgtcactaacctgcagattgcctagcacatagtaggtgcttaataaatgttaccttccttttgtttctctgtaaggatgtgcatgtcttaagatccttgagcaatgtttgttttccttaaataggcatatttgtacctaccctccattacagagatggagataaatatttattgtggaataataataaaatttt

SEQ ID NO: 344459 - DNA, 421 bp, Homo sapiens
acctaataatcatctggagacttagtacttggggggtgagctatagatagccctgtgtatcagggttttccaaacaaacagaaccaatgggatatatatagatatataaagacacttcttataggaattggctcaggagattataaaggccaagaagttccaatatgtgccccctgcaagccgaagaaccaggaaatccagtgtaattcttgcatgtgaagctgaagggctgaagagtgtctgctggtattgaaggctcaagaacctggagctctgaagtcaagggcaggagcagatgatggatgtcccagcttcagaagagagagcaaatttgccttcctccacctcttttatgattcctatgctcagttaattgaatgatgcccactcacattagtgaggatgggtttttgatacccag

SEQ ID NO: 344460 - DNA, 134 bp, Homo sapiens
ggctgaaagatgcgagggaattgaaaatagtgttataattctaggatgtgttctttggaggaaagttaagaagacacgaaatgtaattttaagatgataatgtgtaccaatccacttaacccaactgtcagctc

SEQ ID NO: 344461 - DNA, 838 bp, Homo sapiens
gacaagttcgagcatcttaaaatgattcaacaggaggagataaggaagctcgaggaagagaaaaaaaaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaattaacaatttggacaagacagcaaatgctattgtcgcaagttttctaaagaagaatctgaagtgaaatgacatcaagagacctatcaagacctgtatccaggaaaagaccaaaccaatgcagaccaaaccaatgcagaactcctatgtgctgatggtggtcttacatttccctaagtttctgccgactaaactgtgcacacgttctcaggacctcctgaagctgcgtcacaggcactaatcaaagaacacaaccaagagtttggccttttcttcagcactgggaattgtgatccaaagcttttcctgatgaagcacaaagttggagaaaaaaaagcaaactaaacaacaacaatgaaacagaacagagttaatctgctgtagctcaagagaggatgtacctgcccccaccccgcatccctgggctcgggtttgccttgctgacctctgctgccacctggtgcca

SEQ ID NO: 344462 - DNA, 3843 bp, Homo sapiens
  misc_feature (2550)..(2550): n is a, c, g, or t
  misc_feature (2602)..(2602): n is a, c, g, or t
  misc_feature (3122)..(3122): n is a, c, g, or t
  misc_feature (3171)..(3171): n is a, c, g, or t
  misc_feature (3215)..(3215): n is a, c, g, or t
gacaagttcgagcatcttaaaatgattcaacaggaggagataaggaagctcgaggaagagaaaaaaaaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaattaacaatttggacaagacagcaaatgctattgtcgcaagttttctaaagaagaatctgaagtgaaatgacatcaagagacctatcaagacctgtatccaggaaaagaccaaaccaatgcagaccaaaccaatgcagaactcctatgtgctgatggtggtcttacatttccctaagtttctgccgactaaactgtgcacacgttctcaggacctcctgaagctgcgtcacaggcactaatcaaagaacacaaccaagttgagtgtcaatcatttcaagaaatctatttgcaaggttaaggacacacctgagaaaagaacagagaaccacaggaaaaactgtggtccgtgcttttcccaaagattgtctggggacctcagtaagtaaaggggaaaagtgtgggtattggggaaaggggaagaagtggaaaaaatgggtgtgggtaaatcagaggcaaatggttgcattcttctgtctttggtcagcgttcactgaatacacattttacatgcgatggaggtagaggcagggatgtagcttttttatctttgtgtaatagctatcttatttaggaaccagatgggaagcaggtttgcataagccagttcccagcttggcttttccctttggcttagtgagtctggggtcccaggatttattttccgttctcacaggttgtggtcctcacatttggctcaaaatattcaaaattttttccagagtttggccttttcttcagcactgggaattgtgatccaaagcttttcctgagcagacctgcatgtctgcggtcaactgggttggcagagacagagtgactgtcttcctccaggaagcagcaggttaactggttggcagagacagagggacagagggactgtcttcctccaggaagcagcaggttaactggttggcagagacagagggacagagggactgtcttcctccaggaagcagcaggttggctctggttccttcgtggggcagctggtctccagggcagcaagagagaccaagcccccgtgcacattctacagcctctgtgcacatcagacttgttaatatcccattggccagtgtaagtcacatggccaagcccagattaaggagtggaaagatggacgctatctcctcctgggagaggaggcaaaggaggtgagagcattatgtggccacttatgtttgcaatctaccatacttagccctttgagaaaagaattaactgagaaacttgcttcaaatagggcattcagtaaaatgaagccccaattgaagtaaaatgcatatataaaaaatgaaactgtgaccgattttaaggacagtattggcaaatatttctgtgctcttggaggagaagacccttattggcatgacatgtcagaaaccacaatgaaagaattattttaacttgcattcataaaaattaaaattattcattaaaaacatcgtgaatgaaattaaaagtcaaaatgtaagccagaaaattatttacaatgtatgtgtcaggaaaagacaatacccttcaaactttgagagtttacatcagaaagaaaacagcaaatgacatgatccaaacttgataaaggacatgaaaaagagccagcacttagtatgttttctgaatgaataagtagccaacagcacatgaaaatgcgtgtaatccatttgtaagcagagaaatgcaaactaaaacagtaaagtgtcattttcatttcctggattggcaaagggttttatgtattttactgatagtgctcaatattagcagtaaacaacaaatggtgagtaaatatgagcttcggaacctcagggaaatgatctccttatttcaacctgtagattccttcctacaaccagtgtctacagagcacctactatgtgccaggcacagcctaagtcctgaaggtgtagtctccactgagaaggtgatatttgcacaaagacctgaaagacaggagtgaactgtgtggataactgtgggtacccctacaggcagaggagtagcaatgtgggtcccaaggtgggaccacatcagacatgttcgaggactagctgagggagagaggtgggaggtcagaggagatgggggccggctctgctggccgtcacgagcactctgggtgcagagggcgagaggtgggaggtcagaggagatgggggccggctttgctggccancacgagcactctgggtgctgagggcgagaggtgggaggtcagaggagatggnggctggctctgctggccgtcacgagcactctgggtgctgagggcaagaggtggggaggaggtcagaggagatgggggctggctctgccggccaacacgagcactctgggttttcctccaaatgctatgagagcagaggagtaacctggtctgacttgggtgtgagcagatctctctggttgttgttctggaaaaaactgaggtgcccacgtgaaagcagagatcggttaggaggctgctgcagcaattcaggcaaaaatgggtggcgggcctcgggtgtagtggaggagaagcgatcggattttggatatttgtagctcccccaatacgatttcctggagaaggagatgacttcaatcttctggcctgagtagctgaaaggatgaagctgtccttcgtggaggtggggaatccacagagaagcgggtagggagagagtatcaggagctcagtgttagccatggatgttcgaggggaggtattgagcagctgatagagacacaggcctgtggtcccagganaaggtctgggggtcactagcccatggatggagtcacaggctgcatagantgcaggaaagcgaaggtggagagagaagagcagagtaccagganggaccattgagcaccctggtgttgagagcaagtggcctctagtcagagttgggtcagggccactgtgagtgggctgcccccaacatgagtcggctgtctaggactagtttatctctgcttctcactttactggtattatggggcagctcctgctgtcttccaatttggtgtttgtaaaatgagacataaaaagcaggtgacaaggataccaggaagtgcacaggtctgagtggagtatggggctgtctccaggggagaggtggctgtttggagggaagggtgacaatggataatcagggtccatgggcatccctgcttgttttggagccatggacactcaaataatgtgattttatgaggctattggagaaaaaattggccacagggccaagagggctgggaggaccccagctctccgactggtgtttgcttctctgccatcagggtcgggaggccatgccaagcattgtgatttgcagagtccatgagacaggaacactcccaccacagtgacctgcctctgcacacagccagaatgtagctgactcctttcttctcccacttgcatgcttccaagccttcaaaacatactcatctccatgttctgtgaattagcaatttttaaaaa

SEQ ID NO: 344463 - DNA, 3425 bp, Homo sapiens
  misc_feature (2132)..(2132): n is a, c, g, or t
  misc_feature (2184)..(2184): n is a, c, g, or t
  misc_feature (2704)..(2704): n is a, c, g, or t
  misc_feature (2753)..(2753): n is a, c, g, or t
  misc_feature (2797)..(2797): n is a, c, g, or t
tgagaaagtctcgctctctctcccagtctggagtgcagtggcgtgatcttggctcactgccagctccacctcccaggttcacgccattctcctgcctcagcctcccaagtagctggggctacaggcacctgccaccaaacccggctaatttttttgtatttttagtagagacggggtttcaccgtgttagccaggatcgtcttgatctcctgaccttgtgatccacccgcctcggcctcccaaagtgctgggattacaggtgtgagccaccgcacctggtccaagaacccaagttttagatctagagtgatgtcagcatgacattgatttcctgaggcccaggggtgaaggagctgaggacagcagaggggtgaaggaagtcagctacagacagcagcagctgatgcacaggcctcccagcgcctgaagtcacccggaattgggaagtgctcagaagcttacaaagctgcctcgaggtgggaacacaacattaatccaagagcagatccctgatcctataaaaatgtactagatgcagtgggggcattttaaatgagcagggaaggacagacagataaacagaaggacaaacagtattgggattgggataaatgctcagcttttgcccaaatcttagtgacttaagcatcacttatttgctcacgattctgtggctggaccatttggtttggctcacagggcagggactgtgctggtcttacctgagcagacctgcatgtctgcggtcaactgggttggcagagacagagtgactgtcttcctccaggaagcagcaggttaactggttggcagagacagagggacagagggactgtcttcctccaggaagcagcaggttaactggttggcagagacagagggacagagggactgtcttcctccaggaagcagcaggttggctctggttccttcgtggggcagctggtctccagggcagcaagagagaccaagcccccgtgcacattctacagcctctgtgcacatcagacttgttaatatcccattggccagtgtaagtcacatggccaagcccagattaaggagtggaaagatggacgctatctcctcctgggagaggaggcaaaggaggtgagagcattatgtggccacttatgtttgcaatctaccatacttagccctttgagaaaagaattaactgagaaacttgcttcaaatagggcattcagtaaaatgaagccccaattgaagtaaaatgcatatataaaaaatgaaactgtgaccgattttaaggacagtattggcaaatatttctgtgctcttggaggagaagacccttattggcatgacatgtcagaaaccacaatgaaagaattattttaacttgcattcataaaaattaaaattattcattaaaaacatcgtgaatgaaattaaaagtcaaaatgtaagccagaaaattatttacaatgtatgtgtcaggaaaagacaatacccttcaaactttgagagtttacatcagaaagaaaacagcaaatgacatgatccaaacttgataaaggacatgaaaaagagccagcacttagtatgttttctgaatgaataagtagccaacagcacatgaaaatgcgtgtaatccatttgtaagcagagaaatgcaaactaaaacagtaaagtgtcattttcatttcctggattggcaaagggttttatgtattttactgatagtgctcaatattagcagtaaacaacaaatggtgagtaaatatgagcttcggaacctcagggaaatgatctccttatttcaacctgtagattccttcctacaaccagtgtctacagagcacctactatgtgccaggcacagcctaagtcctgaaggtgtagtctccactgagaaggtgatatttgcacaaagacctgaaagacaggagtgaactgtgtggataactgtgggtacccctacaggcagaggagtagcaatgtgggtcccaaggtgggaccacatcagacatgttcgaggactagctgagggagagaggtgggaggtcagaggagatgggggccggctctgctggccgtcacgagcactctgggtgcagagggcgagaggtgggaggtcagaggagatgggggccggctttgctggccancacgagcactctgggtgctgagggcgagaggtgggaggtcagaggagatggnggctggctctgctggccgtcacgagcactctgggtgctgagggcaagaggtggggaggaggtcagaggagatgggggctggctctgccggccaacacgagcactctgggttttcctccaaatgctatgagagcagaggagtaacctggtctgacttgggtgtgagcagatctctctggttgttgttctggaaaaaactgaggtgcccacgtgaaagcagagatcggttaggaggctgctgcagcaattcaggcaaaaatgggtggcgggcctcgggtgtagtggaggagaagcgatcggattttggatatttgtagctcccccaatacgatttcctggagaaggagatgacttcaatcttctggcctgagtagctgaaaggatgaagctgtccttcgtggaggtggggaatccacagagaagcgggtagggagagagtatcaggagctcagtgttagccatggatgttcgaggggaggtattgagcagctgatagagacacaggcctgtggtcccagganaaggtctgggggtcactagcccatggatggagtcacaggctgcatagantgcaggaaagcgaaggtggagagagaagagcagagtaccagganggaccattgagcaccctggtgttgagagcaagtggcctctagtcagagttgggtcagggccactgtgagtgggctgcccccaacatgagtcggctgtctaggactagtttatctctgcttctcactttactggtattatggggcagctcctgctgtcttccaatttggtgtttgtaaaatgagacataaaaagcaggtgacaaggataccaggaagtgcacaggtctgagtggagtatggggctgtctccaggggagaggtggctgtttggagggaagggtgacaatggataatcagggtccatgggcatccctgcttgttttggagccatggacactcaaataatgtgattttatgaggctattggagaaaaaattggccacagggccaagagggctgggaggaccccagctctccgactggtgtttgcttctctgccatcagggtcgggaggccatgccaagcattgtgatttgcagagtccatgagacaggaacactcccaccacagtgacctgcctctgcacacagccagaatgtagctgactcctttcttctcccacttgcatgcttccaagccttcaaaacatactcatctccatgttctgtgaattagcaatttttaaaaa

SEQ ID NO: 344464 - DNA, 3238 bp, Homo sapiens
  misc_feature (281)..(281): n is a, c, g, or t
  misc_feature (1945)..(1945): n is a, c, g, or t
  misc_feature (1997)..(1997): n is a, c, g, or t
  misc_feature (2517)..(2517): n is a, c, g, or t
  misc_feature (2566)..(2566): n is a, c, g, or t
  misc_feature (2610)..(2610): n is a, c, g, or t
tgagaaagtctcgctctctctcccagtctggagtgcagtggcgtgatcttggctcactgccagctccacctcccaggttcacgccattctcctgcctcagcctcccaagtagctggggctacaggcacctgccaccaaacccggctaatttttttgtatttttagtagagacggggtttcaccgtgttagccaggatcgtcttgatctcctgaccttgtgatccacccgcctcggcctcccaaagtgctgggattacaggtgtgagccaccgcgcttagcnatacctgaccttttagtaaatcaaatttgggcaggtggttctgagagcttgtgtggcatgtatttctcagtgggggcattttaaatgagcagggaaggacagacagataaacagaaggacaaacagtattgggattgggataaatgctcagcttttgcccaaatcttagtgacttaagcatcacttatttgctcacgattctgtggctggaccatttggtttggctcacagggcagggactgtgctggtcttacctgagcagacctgcatgtctgcggtcaactgggttggcagagacagagtgactgtcttcctccaggaagcagcaggttaactggttggcagagacagagggacagagggactgtcttcctccaggaagcagcaggttaactggttggcagagacagagggacagagggactgtcttcctccaggaagcagcaggttggctctggttccttcgtggggcagctggtctccagggcagcaagagagaccaagcccccgtgcacattctacagcctctgtgcacatcagacttgttaatatcccattggccagtgtaagtcacatggccaagcccagattaaggagtggaaagatggacgctatctcctcctgggagaggaggcaaaggaggtgagagcattatgtggccacttatgtttgcaatctaccatacttagccctttgagaaaagaattaactgagaaacttgcttcaaatagggcattcagtaaaatgaagccccaattgaagtaaaatgcatatataaaaaatgaaactgtgaccgattttaaggacagtattggcaaatatttctgtgctcttggaggagaagacccttattggcatgacatgtcagaaaccacaatgaaagaattattttaacttgcattcataaaaattaaaattattcattaaaaacatcgtgaatgaaattaaaagtcaaaatgtaagccagaaaattatttacaatgtatgtgtcaggaaaagacaatacccttcaaactttgagagtttacatcagaaagaaaacagcaaatgacatgatccaaacttgataaaggacatgaaaaagagccagcacttagtatgttttctgaatgaataagtagccaacagcacatgaaaatgcgtgtaatccatttgtaagcagagaaatgcaaactaaaacagtaaagtgtcattttcatttcctggattggcaaagggttttatgtattttactgatagtgctcaatattagcagtaaacaacaaatggtgagtaaatatgagcttcggaacctcagggaaatgatctccttatttcaacctgtagattccttcctacaaccagtgtctacagagcacctactatgtgccaggcacagcctaagtcctgaaggtgtagtctccactgagaaggtgatatttgcacaaagacctgaaagacaggagtgaactgtgtggataactgtgggtacccctacaggcagaggagtagcaatgtgggtcccaaggtgggaccacatcagacatgttcgaggactagctgagggagagaggtgggaggtcagaggagatgggggccggctctgctggccgtcacgagcactctgggtgcagagggcgagaggtgggaggtcagaggagatgggggccggctttgctggccancacgagcactctgggtgctgagggcgagaggtgggaggtcagaggagatggnggctggctctgctggccgtcacgagcactctgggtgctgagggcaagaggtggggaggaggtcagaggagatgggggctggctctgccggccaacacgagcactctgggttttcctccaaatgctatgagagcagaggagtaacctggtctgacttgggtgtgagcagatctctctggttgttgttctggaaaaaactgaggtgcccacgtgaaagcagagatcggttaggaggctgctgcagcaattcaggcaaaaatgggtggcgggcctcgggtgtagtggaggagaagcgatcggattttggatatttgtagctcccccaatacgatttcctggagaaggagatgacttcaatcttctggcctgagtagctgaaaggatgaagctgtccttcgtggaggtggggaatccacagagaagcgggtagggagagagtatcaggagctcagtgttagccatggatgttcgaggggaggtattgagcagctgatagagacacaggcctgtggtcccagganaaggtctgggggtcactagcccatggatggagtcacaggctgcatagantgcaggaaagcgaaggtggagagagaagagcagagtaccagganggaccattgagcaccctggtgttgagagcaagtggcctctagtcagagttgggtcagggccactgtgagtgggctgcccccaacatgagtcggctgtctaggactagtttatctctgcttctcactttactggtattatggggcagctcctgctgtcttccaatttggtgtttgtaaaatgagacataaaaagcaggtgacaaggataccaggaagtgcacaggtctgagtggagtatggggctgtctccaggggagaggtggctgtttggagggaagggtgacaatggataatcagggtccatgggcatccctgcttgttttggagccatggacactcaaataatgtgattttatgaggctattggagaaaaaattggccacagggccaagagggctgggaggaccccagctctccgactggtgtttgcttctctgccatcagggtcgggaggccatgccaagcattgtgatttgcagagtccatgagacaggaacactcccaccacagtgacctgcctctgcacacagccagaatgtagctgactcctttcttctcccacttgcatgcttccaagccttcaaaacatactcatctccatgttctgtgaattagcaatttttaaaaa

SEQ ID NO: 344465 - DNA, 1089 bp, Homo sapiens
tgagaaagtctcgctctctctcccagtctggagtgcagtggcgtgatcttggctcactgccagctccacctcccaggttcacgccattctcctgcctcagcctcccaagtagctggggctacaggcacctgccaccaaacccggctaatttttttgtatttttagtagagacggggtttcaccgtgttagccaggatcgtcttgatctcctgaccttgtgatccacccgcctcggcctcccaaagtgctgggattacaggtgtgagccaccgcacctggtccaagaacccaagttttagatctagagtgatgtcagcatgacattgatttcctgaggcccaggggtgaaggagctgaggacagcagaggggtgaaggaagtcagctacagacagcagcagctgatgcacaggcctcccagcgcctgaagtcacccggaattgggaagtgctcagaagcttacaaagctgcctcgaggaacagtaagaggaccttgtgcatgaataatttgtatccacactgcagacagaagaatcccaagacttcttagagaacccagtgacttaacgcaccttcaatctgtgaaatcctcatgctatacttctgaccgtaatccatcgtacacaacaaacattgaggcaacagatagacaacattcctgacaggaacccgagaaacttacgtctcatattatcatctcatctggacttgacaactgcaaatctcttaagaaccaaacagattcctaaccattgcaaacacgaacaaaccatgcttttgtagaggagtctcacatatcaacatacttacttgttcagaccccccacatgttctcataccataacatattcattcaaaacattacaccacacacaacacaagcaacactcaccacaacaatctcagcacaccatcatggacgtcaagcaagactacacacaccccatcggatgatgcggacgcggcgccccagaagacgaaacaggaacaccggaccaacaacggcaacaccacgaagcacgctcggtacagacgacagagacaccggagcactactaccaaataaaacacgacacgggctagccacagc

SEQ ID NO: 344466 - DNA, 3784 bp, Homo sapiens
  misc_feature (2491)..(2491): n is a, c, g, or t
  misc_feature (2543)..(2543): n is a, c, g, or t
  misc_feature (3063)..(3063): n is a, c, g, or t
  misc_feature (3112)..(3112): n is a, c, g, or t
  misc_feature (3156)..(3156): n is a, c, g, or t
gacaagttcgagcatcttaaaatgattcaacaggaggagataaggaagctcgaggaagagaaaaaaaaactggaaggagaaatcatagatttttataaaatgaaagctgcctctgaagcactgcagactcagctgagcaccgatacaaagaaagacaaacatcctgatccatatgaattcctcttattaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatagttaagctgaattaacaatttggacaagacagcaaatgctattgtcgcaagttttctaaagaagaatctgaagtgaaatgacatcaagagacctatcaagacctgtatccaggaaaagaccaaaccaatgcagaccaaaccaatgcagaactcctatgtgctgatggtggtcttacatttccctaagtttctgccgactaaactgtgcacacgttctcaggacctcctgaagctgcgtcacaggcactaatcaaagaacacaaccaagttgagtgtcaatcatttcaagaaatctatttgcaaggttaaggacacacctgagaaaagaacagagaaccacaggaaaaactgtggtccgtgcttttcccaaagattgtctggggacctcagtaagtaaaggggaaaagtgtgggtattggggaaaggggaagaagtggaaaaaatgggtgtgggtaaatcagaggcaaatggttgcattcttctgtctttggtcagcgttcactgaatacacattttacatgcgatggaggtagaggcagggatgtagcttttttatctttgtgtaatagctatcttatttaggaaccagatgggaagcaggtttgcataagccagttcccagcttggcttttccctttggcttagtgagtctggggtcccaggatttattttccgttctcacaggttgtggtcctcacatttggctcaaaatattcaaaattttttccagagtttggccttttcttcagcactgggaattgtgatccaaagcttttcctgagcagacctgcatgtctgcggtcaactgggttggcagagacagagtgactgtcttcctccaggaagcagcaggttaactggttggcagagacagagggacagagggactgtcttcctccaggaagcagcaggttggctctggttccttcgtggggcagctggtctccagggcagcaagagagaccaagcccccgtgcacattctacagcctctgtgcacatcagacttgttaatatcccattggccagtgtaagtcacatggccaagcccagattaaggagtggaaagatggacgctatctcctcctgggagaggaggcaaaggaggtgagagcattatgtggccacttatgtttgcaatctaccatacttagccctttgagaaaagaattaactgagaaacttgcttcaaatagggcattcagtaaaatgaagccccaattgaagtaaaatgcatatataaaaaatgaaactgtgaccgattttaaggacagtattggcaaatatttctgtgctcttggaggagaagacccttattggcatgacatgtcagaaaccacaatgaaagaattattttaacttgcattcataaaaattaaaattattcattaaaaacatcgtgaatgaaattaaaagtcaaaatgtaagccagaaaattatttacaatgtatgtgtcaggaaaagacaatacccttcaaactttgagagtttacatcagaaagaaaacagcaaatgacatgatccaaacttgataaaggacatgaaaaagagccagcacttagtatgttttctgaatgaataagtagccaacagcacatgaaaatgcgtgtaatccatttgtaagcagagaaatgcaaactaaaacagtaaagtgtcattttcatttcctggattggcaaagggttttatgtattttactgatagtgctcaatattagcagtaaacaacaaatggtgagtaaatatgagcttcggaacctcagggaaatgatctccttatttcaacctgtagattccttcctacaaccagtgtctacagagcacctactatgtgccaggcacagcctaagtcctgaaggtgtagtctccactgagaaggtgatatttgcacaaagacctgaaagacaggagtgaactgtgtggataactgtgggtacccctacaggcagaggagtagcaatgtgggtcccaaggtgggaccacatcagacatgttcgaggactagctgagggagagaggtgggaggtcagaggagatgggggccggctctgctggccgtcacgagcactctgggtgcagagggcgagaggtgggaggtcagaggagatgggggccggctttgctggccancacgagcactctgggtgctgagggcgagaggtgggaggtcagaggagatggnggctggctctgctggccgtcacgagcactctgggtgctgagggcaagaggtggggaggaggtcagaggagatgggggctggctctgccggccaacacgagcactctgggttttcctccaaatgctatgagagcagaggagtaacctggtctgacttgggtgtgagcagatctctctggttgttgttctggaaaaaactgaggtgcccacgtgaaagcagagatcggttaggaggctgctgcagcaattcaggcaaaaatgggtggcgggcctcgggtgtagtggaggagaagcgatcggattttggatatttgtagctcccccaatacgatttcctggagaaggagatgacttcaatcttctggcctgagtagctgaaaggatgaagctgtccttcgtggaggtggggaatccacagagaagcgggtagggagagagtatcaggagctcagtgttagccatggatgttcgaggggaggtattgagcagctgatagagacacaggcctgtggtcccagganaaggtctgggggtcactagcccatggatggagtcacaggctgcatagantgcaggaaagcgaaggtggagagagaagagcagagtaccagganggaccattgagcaccctggtgttgagagcaagtggcctctagtcagagttgggtcagggccactgtgagtgggctgcccccaacatgagtcggctgtctaggactagtttatctctgcttctcactttactggtattatggggcagctcctgctgtcttccaatttggtgtttgtaaaatgagacataaaaagcaggtgacaaggataccaggaagtgcacaggtctgagtggagtatggggctgtctccaggggagaggtggctgtttggagggaagggtgacaatggataatcagggtccatgggcatccctgcttgttttggagccatggacactcaaataatgtgattttatgaggctattggagaaaaaattggccacagggccaagagggctgggaggaccccagctctccgactggtgtttgcttctctgccatcagggtcgggaggccatgccaagcattgtgatttgcagagtccatgagacaggaacactcccaccacagtgacctgcctctgcacacagccagaatgtagctgactcctttcttctcccacttgcatgcttccaagccttcaaaacatactcatctccatgttctgtgaattagcaatttttaaaaa

SEQ ID NO: 344467 - DNA, 544 bp, Homo sapiens
gcacccgtctgtacgtccgactaacttttgtaaaaatagtagagacaaggtttcaccatgttggccaggctggtctcgaactcctgacttcaagtgatccacccacctcggcctcccaaagtgctgggattacaggcatgagctactgcgcccagatgccaagctagagttttaaggcaggaaatgagagaaagatattgagagaggaaaaccaggtggtaagaaaactctaaaggtggccgggcgtggtggctcacgcccatgatctcagcaggagtttgagaacagcctggccaacatggtgaaaccctgtctctactaaaaatacaaaaattaggcaggcgtggtggtgcacgcctataatcccagctatttgggaggctgaggcaggaggacgacttgagtctgggagttcgaggctgcagtgagctctgatcgcaccactgcactccagcctgagtgacacagcgagaccctgcttcaaaaaaaaatttgtggcccaattttgtggccagacccctaggttaacagtgaggatcagtgg

SEQ ID NO: 344468 - DNA, 467 bp, Homo sapiens
caaaacattaatcaaaaattataccccttgaggccatgtaatttggtttttatttagtttattgtctattcaggtccataaagcctacaactgcaacaatatatacagttcatgatgacttaatatttattgaatagtaaaattaatacatgttaagagtagatctggcttcaggtaatcagggctgaagtgatatgtgcagtggtcaaggacaaatgtcaatgtataatctgacctcctgcactcgaaacacacatcaatactttaaatgcctcagaagaaagtcacgtaggagaataaatgaaagaaaatagaaaagttgttaattagattaagaaggaattaaacctggttttaaaatagagagataaagacatacaatataaaaatactgaagaacaagtagcataggcagaggagcactaaaggtataacaggaaagaaatatatctaaaaatattagtttc

SEQ ID NO: 344469 - DNA, 405 bp, Homo sapiens
cacaccagggtttatgggatacaatccatacagtcagctcaccgacagcaactacaggctgggaggaaacccgcccaccaacagctgggtcagggcatcctccgctattaccattccaaaaccctgaaagccaccagataagctgctgatgccctacatgaggtacagcagaaaggtctgagaccaaataaaggcttccaaccctgacctaaagttgtgggagattggctagattattggtggcatgtggcaagatctcactgatgaaaaacaagaatatttaaacgaatacaaagcagaaaagatagagtacaatgaatctatgaaggcctatcataattcccccgtgtactttgcttacataaatgcaaaaagtcgtgcagaagctgttttagagggagaaag

SEQ ID NO: 344470 - DNA, 146 bp, Homo sapiens
aaaaaagaaatgaagagcaacaagagcaacatggctcaatgggctgaaaaaaatgttctgatcactagggactaactaggtaactctgagaagatgtgttgtgtgtgtgtgtgtgtgtgtgtgtgtgtgtgtgtgtgtgtgtgtgt

SEQ ID NO: 344471 - DNA, 420 bp, Homo sapiens
ggcatacttgacattctgtggttggtgtccttatatttacccagttttggttctaggtgtcctctttcacacttcctgtcattggcttatacccctacctgtgtcattggccttaacaaggacttaaagatgccgaaagttcagtataaatcgaactgtaaaccatccacatttgcatatcctgcccctctggaattaccataagaaaaagaaaaggacaaggtttctactgctgtattatctatcactgccaaggctaaaaagaaggaaaaagaaaaaaaaaaaagataagatgagtaggagggcaggtccaaaagaagtgattcagcaaaatgaaaggggtcctcagggattaaaggggatgaatttacctgtcatccctaagaatctacaaaggagatgctcaggacagaaactgta

SEQ ID NO: 344472 - DNA, 522 bp, Homo sapiens
ccagccagtaaatgtttagaagcatagtagtaattagcaggtaggagttgtggggaggaaaggaaactgacatgatgggaagcaggaccagctacaaaatcttcaggaccagctcagaatgaaaatgccggggctcgtgttaaatcttaggatttcaacatggtgacagcagagcactaaaccaagcagggggcccttctagcaggaggccccatggggacctaggaaggaggtcacatccatacaaatgtaaagaaatgtcagagtaaatttcctccattgtccaggagattcggaataggttctcctaagactgatatttcttcattttaatagagttgctcagaaatgaaaaacaatcaatgggaagaaaaagaaaaaaaaaaaagataagatgagtaggagggcaggtccaaaagaagtgattcagcaaaatgaaaggggtcctcagggattaaaggggatgaatttacctgtcatccctaagaatctacaaaggagatgctcaggacagaaactgta

SEQ ID NO: 344473 - DNA, 804 bp, Homo sapiens
catataactgagtggcttataaataacagaaatgtatttctcacagttctggaggctggaaagtccaagattaaggcactggcaaatgtggagtgtgttgagagcccatatcctcatagaccaccatcctctcactctgagctcacatggtagaagggtgaggggtctttggcctcttttataagggcaataatcccatccatgagagtactgccaagatgacctaaccacccctcaatggctccttttcctaataccacacacttgtgggtgaggatttcaacatatgaattttgggggaacataacattaaaatcttagcaaatacattgatggttgaagagtgatgtggtcaggtttttttggggggggcagtttggctgtttttatcaagaccctttttgcatactctttgacccaacaattctgtttttagaaattcatcctaagcaaacagtcatgagcatattagaagatttaactgcagtaactatcattgcattgtttaaagtagcaggaatatgaaaaataacataaatgatataaaatggaatactatgtgccattttaaaatgaagtagaaaaatagttaatgatatgggaaattttcaccaaatactacagtaaaaaagtcggttgacaatagttactgattatgattccatttttgtttaaaaaaataattcacctacatgcatataaaaagaggtatagagaatttctagaagtgtattcaccagaatgcaaacatcagtctctctgattggagggaaaatggatgacctttattttttttttaaattt

SEQ ID NO: 344474 - DNA, 655 bp, Homo sapiens
  misc_feature (581)..(581): n is a, c, g, or t
  misc_feature (631)..(631): n is a, c, g, or t
cgcttgggggcgtggccgaggagccaagcgagccgggggcggggccgcctgggggatgaagtgggggcgctcgcctttcctgcctcactcgcagctgccgggtgttggggaaagagtcgcctgcctccggaccggagtgcagacctctgaccctggagtcgctcggccgctgggaaccgtccccttgggtcgtcgcctgggccgcccgtcgttccccggccccgaggggtccggctggccgcggtgtgggtagaggtcagcatgagccaaggggtccgccgggcaggcgctgggcagggggtagcggccgcggtgcagctgctggtcaccctgagcttcctgcggagcgtcgtcgaggcgcaggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggntgggatgctgggcattctaataagtacttgggagcaattaacaggacatnaagtaatcaaagcggctttcattg

SEQ ID NO: 344475 - DNA, 527 bp, Homo sapiens
cggggagggccgggcagggccgggccagaaaagaggtgatttctggcgagcagaaaacccggggagcagagacctgaccgtccagtgcgggaaacatctgcgaaccgcccgcagggtggggggacggcgacactccgggtaatggcagtcaaaagaggaagatggtgacggtccccctgagctgttttcgttttttcctctcggatgtgttaagcggctgggagtgtggcgggagatgggacgggcatgaaccacctcggctgtcttgcgaagggagcgagcgcccagagaaacggtgacgtccttcccttcaggagttagtgagggagggagactgagagttgggggcactccgcagacccccgaggccccgccaggcgcaggggattgggagggggcaagacttcactcgaactgtcggactagagctttctgggcttttactcttcctcgagcaccttcccttgctcaagattgctttatttttacccagctgagctgtgtctgccaagtggcatcgccaggta

SEQ ID NO: 344476 - DNA, 4642 bp, Homo sapiens
cgcttgggggcgtggccgaggagccaagcgagccgggggcggggccgcctgggggatgaagtgggggcgctcgcctttcctgcctcactcgcagctgccgggtgttggggaaagagtcgcctgcctccggaccggagtgcagacctctgaccctggagtcgctcggccgctgggaaccgtccccttgggtcgtcgcctgggccgcccgtcgttccccggccccgaggggtccggctggccgcggtgtgggtagaggtcagcatgagccaaggggtccgccgggcaggcgctgggcagggggtagcggccgcggtgcagctgctggtcaccctgagcttcctgcggagcgtcgtcgaggcgcaggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggttggaataaaagctgggcattctaataagtacttgaaaatggcaaacaataccaaagaattagaagtttgtgagcaagctaataaactgggagcaattaacagcacattaagtaatcaaagcaaagaagctttcattgactgggcaagatatgatgattcacgggatcacttttgtgaacttgatgatgagagatctccagctgctcagtatgtagacctattgctgaacccagagcgttacactggctataaagggacctctgcatggagagtgtggaacagcatctatgaagagaactgtttcaagcctcgatctgtttatcgtcctttaaatcctctggcgcctagccgaggcgaagatgatggagaatcattctacacatggctagaaggtttgtgtctggagaaaagagtcttctataagcttatatcgggacttcatgctagcatcaatttacatctatgcgcaaattatcttttggaagaaacctggggtaagcccagttggggacctaatattaaagaattcaaacaccgctttgaccctgtggaaaccaagggagaaggtccaagaaggctcaagaatctttactttttatacttgattgagcttcgagctttgtcaaaggtggctccatattttgagcgctcaattgtcgatctttacactggaaatgcagaagaagatgctgacacaaaaactcttctactgaatatctttcaagatacaaagtcctttcccatgcactttgatgagaaatccatgtttgcaggtgacaaaaaaggggccaagtcactaaaggaggaattccgattacatttcaagaatatctcccgtataatggactgtgttggatgtgacaaatgcagattatggggaaaattacagactcagggtttaggaactgccctgaagatattattctctgaaaaagaaatccaaaagcttccagagaatagtccatctaaaggcttccaactcacccgacaggaaatagttgctcttttaaatgcttttggaaggctttctacaagtataagagacttacagaattttaaagtcttattacaacagagtaggtaataaaggcttttatgtgtctaactagagacataaagtgactgtggaaagccttttaattatggacattcatcagaaagacactaatctgacttcaagaattctgaactattaaatagaaaatttaaatgctcacttgaatatttatgattcttaatagattattatcaactagagatatttataaatgaagtatatacttttaaaacatgtaagttatactaattttgtgtttaatttcatatgttttcatgtaatgaaaattctattttttttagaattggttttgtttttattctattatcctttatttccagttgtcaaactttaaatggctatgtctgcattctaataacactgttcagtctgttatggaaaaggagaactagggaacaaatgttgctcagggctggtgtcagtgagaaaaatttatcaatgctttttaatgtgtttttacccttgcctcactgtgtgtgtgtcactttctataatataaagaaatactataatatttctagaatctggaactgtcaccatgatgaatggccctttcaatgcatagttacagaaattcctgaagattccccaggacttcaatttcattggtttttatttgcagtttttagttgctgtaattgttgctgtttccagtctaaaggacctcctttggtaaaggtgaacaagacctctcccctatgctacccagccagattttgtgtgtgtaatgggctggcccaagagtgttcttttacttagaactccttttgattttgcttttctctgcccctagaaattttagggacaaagacattttggaaattgtcagttacttttagaaagaaaacactgcagaaatatttaacagattacttcttgataaaatttaaatgggattatatgaatttataatgccaattgaaaatattatatacacaaaatttgctattttcacttaaagtaagcatttttaaaggatttattttagaatacaatctatgcaatcctcgaactcagtgtgcttttccctgacaggatatataaaaaggtagattaggtcaaccctcctttaagcttactctcccctcaccttttcttttcactgtatataaacggtactttctgtgattcataccaacagaggtactttctgtgattcataccaacagtcctaaactgtcattttctaaatctgggatttaaaatctttagacaatatttaaaatcttgattttttttaaatgtcagcagatacaatttggaagattgcatctgtgtagaagtaatgcaggtacaagatctagagtttttccttagactctttagtcttttctgaattaaagaataagtgctcttaaatccatattttatcctgtcaaagtctgaaatgtgttcattgatgatttggtgacatctaaaaaattgtatttagttggcttggctcacccctcttaaaaatacttagccatctcttggtgggatgtggtgggggtattaaggtctcagagttatttattttctcacctaatttcaaacctttataaacttggggttttgttgttgatggtggtagtattttttgttaagttgtttaaaaggctgacttgattggagcctcctctactttttcttgagggttgcaagtattgtatggtgggggaggggggccttaaggcaaactgtctaaaaagtgactatccaattaatttaactagtaaattagtaagaattattcttagtattcattcagagtttaagatgtgaaaaatctgcactttgtttatcactctaaatgtaaagaactttttgatagtgttatttcaccactccctcagttaaaggctattatttaaactgtttactggagaaaatcctcgctcatgtccatttattgtttttttctgtactgtgatttgtttcaagcttaggaaaactagtatattagagtatgttctaggaaattaaaagatctggttagagtaaaaagttctttttaaggttcttaactaattttttcacaactaagaaaataaatgaagtattcttaggctgaaattcatcttattttatcataaattagattgtaggggcagcctacatttttgtgtatgtgtttttatttcttaaatgattgtgtgagcctggtgacattttatggttcttgtgatctaaactgtttttccaattcacatcttttgtcgtgaagtgatattatactagagtactgtttgcattgtaaaaatgctttgctggtgctctggcattttgtctttatctcatcacctaatttaaaaacccagcacttgataatataactgacagaaatgattgtacccactgatgaagtaatgaaaatgaagaaaaggaaaatattccttccttcaatggcgtaagtttattttttacttaagtggcatctatgtaagttagacaaactatatattaaaattggtaaactttgaatgtttctcctgttttgattcttagattatgaggaggatcagacagaataagactccacacttttgaaatttgataagtcaaaacgttttattttgacatttttaacattgtgaattattcgatatttgtaatctctgtatgtatatgaaactctgccatgtttttcaactttgcctatgtgccactgtatataagaaaggacagctattttgatcttcatcagcattgccttcagctgaaaatttgggaacagttcacagtaaacctctcagtagtttgcaaactgaggtacctgcagaaaccatagctactcaccaaaatacacagattaggtgcatggtatcgtggaaattatttggtaaaaaaacacacacacaaatctatgtgtactgtattttaaggaatatctacaggtgcagctttgattttgaacagaattccaaataatttactgttgtacccaccagaatctagaaaatgtgaattaaagtacatgtttctgcaatcttttctgtcttgt

SEQ ID NO: 344477 - DNA, 4614 bp, Homo sapiens
cgcttgggggcgtggccgaggagccaagcgagccgggggcggggccgcctgggggatgaagtgggggcgctcgcctttcctgcctcactcgcagctgccgggtgttggggaaagagtcgcctgcctccggaccggagtgcagacctctgaccctggagtcgctcggccgctgggaaccgtccccttgggtcgtcgcctgggccgcccgtcgttccccggccccgaggggtccggctggccgcggtgtgggtagaggtcagcatgagccaaggggtccgccgggcaggcgctgggcagggggtagcggccgcggtgcagctgctggtcaccctgagcttcctgcggagcgtcgtcgaggcgcaggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggttggaataaaagctgggcattctaataagtacttgaaaatggcaaacaataccaaagaattagaagtttgtgagcaagctaataaactgggagcaattaacagcacattaagtaatcaaagcaaagaagctttcattgactgggcaagatatgatgattcacgggatcacttttgtgaacttgatgatgagagatctccagctgctcagtatgtagacctattgctgaacccagagcgttacactggctataaagggacctctgcatggagagtgtggaacagcatctatgaagagaactgtttcaagcctcgatctgtttatcgtcctttaaatcctctggcgcctagccgaggcgaagatgatggagaatcattctacacatggctagaaggtttgtgtctggagaaaagagtcttctataagcttatatcgggacttcatgctagcatcaatttacatctatgcgcaaattatcttttggaagaaacctggggtaagcccagttggggacctaatattaaagaattcaaacaccgctttgaccctgtggaaaccaagggagaaggtccaagaaggctcaagaatctttactttttatacttgattgagcttcgagctttgtcaaaggtggctccatattttgagcgctcaattgtcgatctttacactggaaatgcagaagaagatgctgacacaaaaactcttctactgaatatctttcaagatacaaagtcctttcccatgcactttgatgagaaatccatgtttgcaggtgacaaaaaaggggccaagtcactaaaggaggaattccgattacatttcaagaatatctcccgtataatggactgtgttggatgtgacaaatgcagattatggggaaaattacagactcagggtttaggaactgccctgaagatattattctctgaaaaagaaatccaaaagcttccagagaatagtccatctaaaggcttccaactcacccgacaggaaatagttgctcttttaaatgcttttggaaggctttctacaagtataagagacttacagaattttaaagtcttattacaacagagtaggtaataaaggcttttatgtgtctaactagagacataaagtgactgtggaaagccttttaattatggacattcatcagaaagacactaatctgacttcaagaattctgaactattaaatagaaaatttaaatgctcacttgaatatttatgattcttaatagattattatcaactagagatatttataaatgaagtatatacttttaaaacatgtaagttatactaattttgtgtttaatttcatatgttttcatgtaatgaaaattctattttttttagaattggttttgtttttattctattatcctttatttccagttgtcaaactttaaatggctatgtctgcattctaataacactgttcagtctgttatggaaaaggagaactagggaacaaatgttgctcagggctggtgtcagtgagaaaaatttatcaatgctttttaatgtgtttttacccttgcctcactgtgtgtgtgtcactttctataatataaagaaatactataatatttctagaatctggaactgtcaccatgatgaatggccctttcaatgcatagttacagaaattcctgaagattccccaggacttcaatttcattggtttttatttgcagtttttagttgctgtaattgttgctgtttccagtctaaaggacctcctttggtaaaggtgaacaagacctctcccctatgctacccagccagattttgtgtgtgtaatgggctggcccaagagtgttcttttacttagaactccttttgattttgcttttctctgcccctagaaattttagggacaaagacattttggaaattgtcagttacttttagaaagaaaacactgcagaaatatttaacagattacttcttgataaaatttaaatgggattatatgaatttataatgccaattgaaaatattatatacacaaaatttgctattttcacttaaagtaagcatttttaaaggatttattttagaatacaatctatgcaatcctcgaactcagtgtgcttttccctgacaggatatataaaaaggtagattaggtcaaccctcctttaagcttactctcccctcaccttttcttttcactgtatataaacggtactttctgtgattcataccaacagtcctaaactgtcattttctaaatctgggatttaaaatctttagacaatatttaaaatcttgattttttttaaatgtcagcagatacaatttggaagattgcatctgtgtagaagtaatgcaggtacaagatctagagtttttccttagactctttagtcttttctgaattaaagaataagtgctcttaaatccatattttatcctgtcaaagtctgaaatgtgttcattgatgatttggtgacatctaaaaaattgtatttagttggcttggctcacccctcttaaaaatacttagccatctcttggtgggatgtggtgggggtattaaggtctcagagttatttattttctcacctaatttcaaacctttataaacttggggttttgttgttgatggtggtagtattttttgttaagttgtttaaaaggctgacttgattggagcctcctctactttttcttgagggttgcaagtattgtatggtgggggaggggggccttaaggcaaactgtctaaaaagtgactatccaattaatttaactagtaaattagtaagaattattcttagtattcattcagagtttaagatgtgaaaaatctgcactttgtttatcactctaaatgtaaagaactttttgatagtgttatttcaccactccctcagttaaaggctattatttaaactgtttactggagaaaatcctcgctcatgtccatttattgtttttttctgtactgtgatttgtttcaagcttaggaaaactagtatattagagtatgttctaggaaattaaaagatctggttagagtaaaaagttctttttaaggttcttaactaattttttcacaactaagaaaataaatgaagtattcttaggctgaaattcatcttattttatcataaattagattgtaggggcagcctacatttttgtgtatgtgtttttatttcttaaatgattgtgtgagcctggtgacattttatggttcttgtgatctaaactgtttttccaattcacatcttttgtcgtgaagtgatattatactagagtactgtttgcattgtaaaaatgctttgctggtgctctggcattttgtctttatctcatcacctaatttaaaaacccagcacttgataatataactgacagaaatgattgtacccactgatgaagtaatgaaaatgaagaaaaggaaaatattccttccttcaatggcgtaagtttattttttacttaagtggcatctatgtaagttagacaaactatatattaaaattggtaaactttgaatgtttctcctgttttgattcttagattatgaggaggatcagacagaataagactccacacttttgaaatttgataagtcaaaacgttttattttgacatttttaacattgtgaattattcgatatttgtaatctctgtatgtatatgaaactctgccatgtttttcaactttgcctatgtgccactgtatataagaaaggacagctattttgatcttcatcagcattgccttcagctgaaaatttgggaacagttcacagtaaacctctcagtagtttgcaaactgaggtacctgcagaaaccatagctactcaccaaaatacacagattaggtgcatggtatcgtggaaattatttggtaaaaaaacacacacacaaatctatgtgtactgtattttaaggaatatctacaggtgcagctttgattttgaacagaattccaaataatttactgttgtacccaccagaatctagaaaatgtgaattaaagtacatgtttctgcaatcttttctgtcttgt

SEQ ID NO: 344478 - DNA, 3310 bp, Homo sapiens
tgtaaatgatttgagattctttattaagaattattcatatcactgttcccattattaatctaatgtctgtagatagtatgaagtaacaggcttcctttgccccttctaaaccagtcttaatgagaacactaatttaaacatggaagcttcagtgtttgaggttttttattttaggttttgctttcaaattatagcttatgtaacaatatcaataatttgaaacagtatgcaacatgttagccttactaataagctttttctttcttccataggctttctacaagtataagagacttacagaattttaaagtcttattacaacagagtaggtaataaaggcttttatgtgtctaactagagacataaagtgactgtggaaagccttttaattatggacattcatcagaaagacactaatctgacttcaagaattctgaactattaaatagaaaatttaaatgctcacttgaatatttatgattcttaatagattattatcaactagagatatttataaatgaagtatatacttttaaaacatgtaagttatactaattttgtgtttaatttcatatgttttcatgtaatgaaaattctattttttttagaattggttttgtttttattctattatcctttatttccagttgtcaaactttaaatggctatgtctgcattctaataacactgttcagtctgttatggaaaaggagaactagggaacaaatgttgctcagggctggtgtcagtgagaaaaatttatcaatgctttttaatgtgtttttacccttgcctcactgtgtgtgtgtcactttctataatataaagaaatactataatatttctagaatctggaactgtcaccatgatgaatggccctttcaatgcatagttacagaaattcctgaagattccccaggacttcaatttcattggtttttatttgcagtttttagttgctgtaattgttgctgtttccagtctaaaggacctcctttggtaaaggtgaacaagacctctcccctatgctacccagccagattttgtgtgtgtaatgggctggcccaagagtgttcttttacttagaactccttttgattttgcttttctctgcccctagaaattttagggacaaagacattttggaaattgtcagttacttttagaaagaaaacactgcagaaatatttaacagattacttcttgataaaatttaaatgggattatatgaatttataatgccaattgaaaatattatatacacaaaatttgctattttcacttaaagtaagcatttttaaaggatttattttagaatacaatctatgcaatcctcgaactcagtgtgcttttccctgacaggatatataaaaaggtagattaggtcaaccctcctttaagcttactctcccctcaccttttcttttcactgtatataaacggtactttctgtgattcataccaacagaggtactttctgtgattcataccaacagtcctaaactgtcattttctaaatctgggatttaaaatctttagacaatatttaaaatcttgattttttttaaatgtcagcagatacaatttggaagattgcatctgtgtagaagtaatgcaggtacaagatctagagtttttccttagactctttagtcttttctgaattaaagaataagtgctcttaaatccatattttatcctgtcaaagtctgaaatgtgttcattgatgatttggtgacatctaaaaaattgtatttagttggcttggctcacccctcttaaaaatacttagccatctcttggtgggatgtggtgggggtattaaggtctcagagttatttattttctcacctaatttcaaacctttataaacttggggttttgttgttgatggtggtagtattttttgttaagttgtttaaaaggctgacttgattggagcctcctctactttttcttgagggttgcaagtattgtatggtgggggaggggggccttaaggcaaactgtctaaaaagtgactatccaattaatttaactagtaaattagtaagaattattcttagtattcattcagagtttaagatgtgaaaaatctgcactttgtttatcactctaaatgtaaagaactttttgatagtgttatttcaccactccctcagttaaaggctattatttaaactgtttactggagaaaatcctcgctcatgtccatttattgtttttttctgtactgtgatttgtttcaagcttaggaaaactagtatattagagtatgttctaggaaattaaaagatctggttagagtaaaaagttctttttaaggttcttaactaattttttcacaactaagaaaataaatgaagtattcttaggctgaaattcatcttattttatcataaattagattgtaggggcagcctacatttttgtgtatgtgtttttatttcttaaatgattgtgtgagcctggtgacattttatggttcttgtgatctaaactgtttttccaattcacatcttttgtcgtgaagtgatattatactagagtactgtttgcattgtaaaaatgctttgctggtgctctggcattttgtctttatctcatcacctaatttaaaaacccagcacttgataatataactgacagaaatgattgtacccactgatgaagtaatgaaaatgaagaaaaggaaaatattccttccttcaatggcgtaagtttattttttacttaagtggcatctatgtaagttagacaaactatatattaaaattggtaaactttgaatgtttctcctgttttgattcttagattatgaggaggatcagacagaataagactccacacttttgaaatttgataagtcaaaacgttttattttgacatttttaacattgtgaattattcgatatttgtaatctctgtatgtatatgaaactctgccatgtttttcaactttgcctatgtgccactgtatataagaaaggacagctattttgatcttcatcagcattgccttcagctgaaaatttgggaacagttcacagtaaacctctcagtagtttgcaaactgaggtacctgcagaaaccatagctactcaccaaaatacacagattaggtgcatggtatcgtggaaattatttggtaaaaaaacacacacacaaatctatgtgtactgtattttaaggaatatctacaggtgcagctttgattttgaacagaattccaaataatttactgttgtacccaccagaatctagaaaatgtgaattaaagtacatgtttctgcaatcttttctgtcttgt

SEQ ID NO: 344479 - DNA, 1722 bp, Homo sapiens
cgcttgggggcgtggccgaggagccaagcgagccgggggcggggccgcctgggggatgaagtgggggcgctcgcctttcctgcctcactcgcagctgccgggtgttggggaaagagtcgcctgcctccggaccggagtgcagacctctgaccctggagtcgctcggccgctgggaaccgtccccttgggtcgtcgcctgggccgcccgtcgttccccggccccgaggggtccggctggccgcggtgtgggtagaggtcagcatgagccaaggggtccgccgggcaggcgctgggcagggggtagcggccgcggtgcagctgctggtcaccctgagcttcctgcggagcgtcgtcgaggcgcaggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggttggaataaaagctgggcattctaataagtacttgaaaatggcaaacaataccaaagaattagaagtttgtgagcaagctaataaactgggagcaattaacagcacattaagtaatcaaagcaaagaagctttcattgactgggcaagatatgatgattcacgggatcacttttgtgaacttgatgatgagagatctccagctgctcagtatgtagacctattgctgaacccagagcgttacactggctataaagggacctctgcatggagagtgtggaacagcatctatgaagagaactgtttcaagcctcgatctgtttatcgtcctttaaatcctctggcgcctagccgaggcgaagatgatggagaatcattctacacatggctagaaggtttgtgtctggagaaaagagtcttctataagcttatatcgggacttcatgctagcatcaatttacatctatgcgcaaattatcttttggaagaaacctggggtaagcccagttggggacctaatattaaagaattcaaacaccgctttgaccctgtggaaaccaagggagaaggtccaagaaggctcaagaatctttactttttatacttgattgagcttcgagctttgtcaaaggtggctccatattttgagcgctcaattgtcgatctttacactggaaatgcagaagaagatgctgacacaaaaactcttctactgaatatctttcaagatacaaagtcctttcccatgcactttgatgagaaatccatgtttgcaggtgacaaaaaaggggccaagtcactaaaggaggaattccgattacatttcaagaatatctcccgtataatggactgtgttggatgtgacaaatgcagattatggggaaaattacagactcagggtttaggaactgccctgaagatattattctctgaaaaagaaatccaaaagcttccagagaatagtccatctaaaggcttccaactcacccgacaggaaatagttgctcttttaaatgcttttggaaggtaagaaccattatatgttgaagatttttgatttcccattgggtttcaacaaactgcaaagataatcttctttgctaaaagtagggtttgttttgttgacaaaaaaaattttatattg

SEQ ID NO: 344480 - DNA, 1257 bp, Homo sapiens
cgcttgggggcgtggccgaggagccaagcgagccgggggcggggccgcctgggggatgaagtgggggcgctcgcctttcctgcctcactcgcagctgccgggtgttggggaaagagtcgcctgcctccggaccggagtgcagacctctgaccctggagtcgctcggccgctgggaaccgtccccttgggtcgtcgcctgggccgcccgtcgttccccggccccgaggggtccggctggccgcggtgtgggtagaggtcagcatgagccaaggggtccgccgggcaggcgctgggcagggggtagcggccgcggtgcagctgctggtcaccctgagcttcctgcggagcgtcgtcgaggcgcaggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggttggaataaaagctgggcattctaataagtacttgaaaatggcaaacaataccaaagaattagaagtttgtgagcaagctaataaactgggagcaattaacagcacattaagtaatcaaagcaaagaagctttcattgactgggcaagatatgatgattcacgggatcacttttgtgaacttgatggtaatacaataaactattataattaaattattttaactttaacccttttataagacattttaatcaatgaaaatataaactgaattatagcttcagtactggattttgctatgtagaccttattattcgtaatggcatttattgagagcctgtgttccaggccctatgttaagtgccttaaatacattatttctggtctttgcagctaccttcataagtgtgtattatttcatatctgagaaaactgagtctgaaaaagactaaataacttgcccaagatcacacaatagcaagaggctgaggcaggatttgatcccatatccgaatccaaaacctgtattctttccattatgatataccatctgccatggaccttcaattgaagccacttagttataggtctgtgaacattttgtaaaaatatttacactggaatttgctagaggtcttaacaaactcatgtaaagatgctttctaatgctggggaggac

SEQ ID NO: 344481 - DNA, 1174 bp, Homo sapiens
cgcttgggggcgtggccgaggagccaagcgagccgggggcggggccgcctgggggatgaagtgggggcgctcgcctttcctgcctcactcgcagctgccgggtgttggggaaagagtcgcctgcctccggaccggagtgcagacctctgaccctggagtcgctcggccgctgggaaccgtccccttgggtcgtcgcctgggccgcccgtcgttccccggccccgaggggtccggctggccgcggtgtgggtagaggtcagcatgagccaaggggtccgccgggcaggcgctgggcagggggtagcggccgcggtgcagctgctggtcaccctgagcttcctgcggagcgtcgtcgaggcgcaggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggttggaataaaagctgggcattctaataagtaatcaaagcaaagaagctttcattgactgggcaagatatgatgattcacgggatcacttttgtgaacttgatggtaatacaataaactattataattaaattattttaactttaacccttttataagacattttaatcaatgaaaatataaactgaattatagcttcagtactggattttgctatgtagaccttattattcgtaatggcatttattgagagcctgtgttccaggccctatgttaagtgccttaaatacattatttctggtctttgcagctaccttcataagtgtgtattatttcatatctgagaaaactgagtctgaaaaagactaaataacttgcccaagatcacacaatagcaagaggctgaggcaggatttgatcccatatccgaatccaaaacctgtattctttccattatgatataccatctgccatggaccttcaattgaagccacttagttataggtctgtgaacattttgtaaaaatatttacactggaatttgctagaggtcttaacaaactcatgtaaagatgctttctaatgctggggaggac

SEQ ID NO: 344482 - DNA, 556 bp, Homo sapiens
gatctccagctgctcagtatgtagacctattgctgaacccagagcgttacactggctataaagggacctctgcatggagagtgtggaacagcatctatgaagagaactgtttcaagtaactggagggggtgggggaagaaggaacgactgatagagggtcgggagaggccgggtgctgtggctcacgcctgtaatcccagcactttgggaggccaaggtgggtggatcatctgaggtcaggagttcaagaccagcctggccaacatggtgaaaccccgtgtcaactaaaaatacaaaaaaattagccgggcatgatggcaggtgcctgtaatcccagctacttgggaggctgaggcaggagaatcacttgaacccgggaggcagaggttacaatgagcagagattgcgccactgtactccagcctgggtgactaagtgaaactctgtctcaaaaaaaaaagagggtggggaggggagtatttgtttctattggaataaaattatacactataaaagttaaaacattctatgtttgggtattatgctttctttttca

SEQ ID NO: 344483 - DNA, 1866 bp, Homo sapiens
cgcttgggggcgtggccgaggagccaagcgagccgggggcggggccgcctgggggatgaagtgggggcgctcgcctttcctgcctcactcgcagctgccgggtgttggggaaagagtcgcctgcctccggaccggagtgcagacctctgaccctggagtcgctcggccgctgggaaccgtccccttgggtcgtcgcctgggccgcccgtcgttccccggccccgaggggtccggctggccgcggtgtgggtagaggtcagcatgagccaaggggtccgccgggcaggcgctgggcagggggtagcggccgcggtgcagctgctggtcaccctgagcttcctgcggagcgtcgtcgaggcgcaggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggttggaataaaagctgggcattctaataagtacttgaaaatggcaaacaataccaaagaattagaagtttgtgagcaagctaataaactgggagcaattaacagcacattaagtaatcaaagcaaagaagctttcattgactgggcaagatatgatgattcacgggatcacttttgtgaacttgatgatgagagatctccagctgctcagtatgtagacctattgctgaacccagagcgttacactggctataaagggacctctgcatggagagtgtggaacagcatctatgaagagaactgtttcaagcctcgatctgtttatcgtcctttaaatcctctggcgcctagccgaggcgaagatgatggagaatcattctacacatggctagaaggtttgtgtctggagaaaagagtcttctataagcttatatcgggacttcatgctagcatcaatttacatctatgcgcaaattatcttttggaagaaacctggggtaagcccagttggggacctaatattaaagaattcaaacaccgctttgaccctgtggaaaccaagggagaaggtccaagaaggctcaagaatctttactttttatacttgattgagcttcgagctttgtcaaaggtggctccatattttgagcgctcaattgtcgatctttacactggaaatgcagaagaagatgctgacacaaaaactcttctactgaatatctttcaagatacaaagtcctttcccatgcactttgatgagaaatccatgtttgcaggtgacaaaaaaggggccaagtcactaaaggaggaattccgattacatttcaagaatatctcccgtataatggactgtgttggatgtgacaaatgcagattatggggaaaattacagactcagggtttaggaactgccctgaagatattattctctgaaaaagaaatccaaaagcttccagagaatagtccatctaaaggcttccaactcacccgacaggaaatagttgctcttttaaatgcttttggaaggctttctacaagtataagagacttacagaattttaaagtcttattacaacagagtaggtaataaaggcttttatgtgtctaactagagacataaagtgactgtggaaagccttttaattatggacattcatcagaaagacactaatctgacttcaagaattctgaactattaaatagaaaatttaaatgctcacttgaatatttatgattcttaatagattattatcaactagagatatttataaatgaagtatatactttt

SEQ ID NO: 344484 - DNA, 4417 bp, Homo sapiens
cggggagggccgggcagggccgggccagaaaagaggtgatttctggcgagcagaaaacccggggagcagagacctgaccgtccagtgcgggaaacatctgcgaaccgcccgcagggtggggggacggcgacactccgggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggttggaataaaagctgggcattctaataagtacttgaaaatggcaaacaataccaaagaattagaagtttgtgagcaagctaataaactgggagcaattaacagcacattaagtaatcaaagcaaagaagctttcattgactgggcaagatatgatgattcacgggatcacttttgtgaacttgatgatgagagatctccagctgctcagtatgtagacctattgctgaacccagagcgttacactggctataaagggacctctgcatggagagtgtggaacagcatctatgaagagaactgtttcaagcctcgatctgtttatcgtcctttaaatcctctggcgcctagccgaggcgaagatgatggagaatcattctacacatggctagaaggtttgtgtctggagaaaagagtcttctataagcttatatcgggacttcatgctagcatcaatttacatctatgcgcaaattatcttttggaagaaacctggggtaagcccagttggggacctaatattaaagaattcaaacaccgctttgaccctgtggaaaccaagggagaaggtccaagaaggctcaagaatctttactttttatacttgattgagcttcgagctttgtcaaaggtggctccatattttgagcgctcaattgtcgatctttacactggaaatgcagaagaagatgctgacacaaaaactcttctactgaatatctttcaagatacaaagtcctttcccatgcactttgatgagaaatccatgtttgcaggtgacaaaaaaggggccaagtcactaaaggaggaattccgattacatttcaagaatatctcccgtataatggactgtgttggatgtgacaaatgcagattatggggaaaattacagactcagggtttaggaactgccctgaagatattattctctgaaaaagaaatccaaaagcttccagagaatagtccatctaaaggcttccaactcacccgacaggaaatagttgctcttttaaatgcttttggaaggctttctacaagtataagagacttacagaattttaaagtcttattacaacagagtaggtaataaaggcttttatgtgtctaactagagacataaagtgactgtggaaagccttttaattatggacattcatcagaaagacactaatctgacttcaagaattctgaactattaaatagaaaatttaaatgctcacttgaatatttatgattcttaatagattattatcaactagagatatttataaatgaagtatatacttttaaaacatgtaagttatactaattttgtgtttaatttcatatgttttcatgtaatgaaaattctattttttttagaattggttttgtttttattctattatcctttatttccagttgtcaaactttaaatggctatgtctgcattctaataacactgttcagtctgttatggaaaaggagaactagggaacaaatgttgctcagggctggtgtcagtgagaaaaatttatcaatgctttttaatgtgtttttacccttgcctcactgtgtgtgtgtcactttctataatataaagaaatactataatatttctagaatctggaactgtcaccatgatgaatggccctttcaatgcatagttacagaaattcctgaagattccccaggacttcaatttcattggtttttatttgcagtttttagttgctgtaattgttgctgtttccagtctaaaggacctcctttggtaaaggtgaacaagacctctcccctatgctacccagccagattttgtgtgtgtaatgggctggcccaagagtgttcttttacttagaactccttttgattttgcttttctctgcccctagaaattttagggacaaagacattttggaaattgtcagttacttttagaaagaaaacactgcagaaatatttaacagattacttcttgataaaatttaaatgggattatatgaatttataatgccaattgaaaatattatatacacaaaatttgctattttcacttaaagtaagcatttttaaaggatttattttagaatacaatctatgcaatcctcgaactcagtgtgcttttccctgacaggatatataaaaaggtagattaggtcaaccctcctttaagcttactctcccctcaccttttcttttcactgtatataaacggtactttctgtgattcataccaacagaggtactttctgtgattcataccaacagtcctaaactgtcattttctaaatctgggatttaaaatctttagacaatatttaaaatcttgattttttttaaatgtcagcagatacaatttggaagattgcatctgtgtagaagtaatgcaggtacaagatctagagtttttccttagactctttagtcttttctgaattaaagaataagtgctcttaaatccatattttatcctgtcaaagtctgaaatgtgttcattgatgatttggtgacatctaaaaaattgtatttagttggcttggctcacccctcttaaaaatacttagccatctcttggtgggatgtggtgggggtattaaggtctcagagttatttattttctcacctaatttcaaacctttataaacttggggttttgttgttgatggtggtagtattttttgttaagttgtttaaaaggctgacttgattggagcctcctctactttttcttgagggttgcaagtattgtatggtgggggaggggggccttaaggcaaactgtctaaaaagtgactatccaattaatttaactagtaaattagtaagaattattcttagtattcattcagagtttaagatgtgaaaaatctgcactttgtttatcactctaaatgtaaagaactttttgatagtgttatttcaccactccctcagttaaaggctattatttaaactgtttactggagaaaatcctcgctcatgtccatttattgtttttttctgtactgtgatttgtttcaagcttaggaaaactagtatattagagtatgttctaggaaattaaaagatctggttagagtaaaaagttctttttaaggttcttaactaattttttcacaactaagaaaataaatgaagtattcttaggctgaaattcatcttattttatcataaattagattgtaggggcagcctacatttttgtgtatgtgtttttatttcttaaatgattgtgtgagcctggtgacattttatggttcttgtgatctaaactgtttttccaattcacatcttttgtcgtgaagtgatattatactagagtactgtttgcattgtaaaaatgctttgctggtgctctggcattttgtctttatctcatcacctaatttaaaaacccagcacttgataatataactgacagaaatgattgtacccactgatgaagtaatgaaaatgaagaaaaggaaaatattccttccttcaatggcgtaagtttattttttacttaagtggcatctatgtaagttagacaaactatatattaaaattggtaaactttgaatgtttctcctgttttgattcttagattatgaggaggatcagacagaataagactccacacttttgaaatttgataagtcaaaacgttttattttgacatttttaacattgtgaattattcgatatttgtaatctctgtatgtatatgaaactctgccatgtttttcaactttgcctatgtgccactgtatataagaaaggacagctattttgatcttcatcagcattgccttcagctgaaaatttgggaacagttcacagtaaacctctcagtagtttgcaaactgaggtacctgcagaaaccatagctactcaccaaaatacacagattaggtgcatggtatcgtggaaattatttggtaaaaaaacacacacacaaatctatgtgtactgtattttaaggaatatctacaggtgcagctttgattttgaacagaattccaaataatttactgttgtacccaccagaatctagaaaatgtgaattaaagtacatgtttctgcaatcttttctgtcttgt

SEQ ID NO: 344485 - DNA, 4091 bp, Homo sapiens
cgcttgggggcgtggccgaggagccaagcgagccgggggcggggccgcctgggggatgaagtgggggcgctcgcctttcctgcctcactcgcagctgccgggtgttggggaaagagtcgcctgcctccggaccggagtgcagacctctgaccctggagtcgctcggccgctgggaaccgtccccttgggtcgtcgcctgggccgcccgtcgttccccggccccgaggggtccggctggccgcggtgtgggtagaggtcagcatgagccaaggggtccgccgggcaggcgctgggcagggggtagcggccgcggtgcagctgctggtcaccctgagcttcctgcggagcgtcgtcgaggcgcaggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggttggaataaaagctgggcattctaataagtacttgaaaatggcaaacaataccaaagaattagaagtttgtgagcaagctaataaactgggagcaattaacagcacattaagtaatcaaagcaaagaagctttcattgactgggcaagatatgatgattcacgggatcacttttgtgaacttgatgatgagagatctccagctgctcagtatgtagacctattgctgaacccagagcgttacactggctataaagggacctctgcatggagagtgtggaacagcatctatgaagagaactgtttcaagcctcgatctgtttatcgtcctttaaatcctctggcgcctagccgaggcgaagatgatggagaatcattctacacatggctagaaggtttgtgtctggagaaaagagtcttctataagcttatatcgggacttcatgctagcatcaatttacatctatgcgcaaattatcttttggaagaaacctggggtaagcccagttggggacctaatattaaagaattcaaacaccgctttgaccctgtggaaaccaagggagaaggtccaagaaggctcaagaatctttactttttatacttgattgagcttcgagctttgtcaaaggtggctccatattttgagcgctcaattgtcgatctttacactggaaatgcagaagaagatgctgacacaaaaactcttctactgaatatctttcaagatacaaagtcctttcccatgcactttgatgagaaatccatgtttgcaggtgacaaaaaaggggccaagtcactaaaggaggaattccgattacatttcaagaatatctcccgtataatggactgtgttggatgtgacaaatgcagattatggggaaaattacagactcagggtttaggaactgccctgaagatattattctctgaaaaagaaatccaaaagcttccagagaatagtccatctaaaggcttccaactcacccgacaggaaatagttgctcttttaaatgcttttggaaggctttctacaagtataagagacttacagaattttaaagtcttattacaacagagtaggtaataaaggcttttatgtgtctaactagagacataaagtgactgtggaaagccttttaattatggacattcatcagaaagacactaatctgacttcaagaattctgaactattaaatagaaaatttaaatgctcacttgaatatttatgattcttaatagattattatcaactagagatatttataaatgaagtatatacttttaaaacatgtaagttatactaattttgtgtttaatttcatatgttttcatgtaatgaaaattctattttttttagaattggttttgtttttattctattatcctttatttccagttgtcaaactttaaatggctatgtctgcattctaataacactgttcagtctgttatggaaaaggagaactagggaacaaatgttgctcagggctggtgtcagtgagaaaaatttatcaatgctttttaatgtgtttttacccttgcctcactgtgtgtgtgtcactttctataatataaagaaatactataatatttctagaatctggaactgtcaccatgatgaatggccctttcaatgcatagttacagaaattcctgaagattccccaggacttcaatttcattggtttttatttgcagtttttagttgctgtaattgttgctgtttccagtctaaaggacctcctttggtaaaggtgaacaagacctctcccctatgctacccagccagattttgtgtgtgtaatgggctggcccaagagtgttcttttacttagaactccttttgattttgcttttctctgcccctagaaattttagggacaaagacattttggaaattgtcagttacttttagaaagaaaacactgcagaaatatttaacagattacttcttgataaaatttaaatgggattatatgaatttataatgccaattgaaaatattatatacacaaaatttgctattttcacttaaagtaagcatttttaaaggatttattttagaatacaatctatgcaatcctcgaactcagtgtgcttttccctgacaggatatataaaaaggtagattaggtcaaccctcctttaagcttactctcccctcaccttttcttttcactgtatataaacggtactttctgtgattcataccaacagtcctaaactgtcattttctaaatctgggatttaaaatctttagacaatatttaaaatcttgattttttttaaatgtcagcagatacaatttggaagattgcatctgtgtagaagtaatgcaggtacaagatctagagtttttccttagactctttagtcttttctgaattaaagaataagtgctcttaaatccatattttatcctgtcaaagtctgaaatgtgttcattgatgatttggtgacatctaaaaaattgtatttagttggcttggctcacccctcttaaaaatacttagccatctcttggtgggatgtggtgggggtattaaggtctcagagttatttattttctcacctaatttcaaacctttataaacttggggttttgttgttgatggtggtagtattttttgttaagttgtttaaaaggctgacttgattggagcctcctctactttttcttgagggttgcaagtattgtatggtgggggaggggggccttaaggcaaactgtctaaaaagtgactatccaattaatttaactagtaaattagtaagaattattcttagtattcattcagagtttaagatgtgaaaaatctgcactttgtttatcactctaaatgtaaagaactttttgatagtgttatttcaccactccctcagttaaaggctattatttaaactgtttactggagaaaatcctcgctcatgtccatttattgtttttttctgtactgtgatttgtttcaagcttaggaaaactagtatattagagtatgttctaggaaattaaaagatctggttagagtaaaaagttctttttaaggttcttaactaattttttcacaactaagaaaataaatgaagtattcttaggctgaaattcatcttattttatcataaattagattgtaggggcagcctacatttttgtgtatgtgtttttatttcttaaatgattgtgtgagcctggtgacattttatggttcttgtgatctaaactgtttttccaattcacatcttttgtcgtgaagtgatattatactagagtactgtttgcattgtaaaaatgctttgctggtgctctggcattttgtctttatctcatcacctaatttaaaaacccagcacttgataatataactgacagaaatgattgtacccactgatgaagtaatgaaaatgaagaaaaggaaaatattccttccttcaatggcgtaagtttattttttacttaagcggatcagcgctgatccgcttaaggcatccatcttaatcctggggcttt

SEQ ID NO: 344486 - DNA, 1800 bp, Homo sapiens
cgcttgggggcgtggccgaggagccaagcgagccgggggcggggccgcctgggggatgaagtgggggcgctcgcctttcctgcctcactcgcagctgccgggtgttggggaaagagtcgcctgcctccggaccggagtgcagacctctgaccctggagtcgctcggccgctgggaaccgtccccttgggtcgtcgcctgggccgcccgtcgttccccggccccgaggggtccggctggccgcggtgtgggtagaggtcagcatgagccaaggggtccgccgggcaggcgctgggcagggggtagcggccgcggtgcagctgctggtcaccctgagcttcctgcggagcgtcgtcgaggcgcaggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggttggaataaaagctgggcattctaataagtacttgaaaatggcaaacaataccaaagaattagaagtttgtgagcaagctaataaactgggagcaattaacagcacattaagtaatcaaagcaaagaagctttcattgactgggcaagatatgatgattcacgggatcacttttgtgaacttgatgatgagagatctccagctgctcagtatgtagacctattgctgaacccagagcgttacactggctataaagggacctctgcatggagagtgtggaacagcatctatgaagagaactgtttcaagcctcgatctgtttatcgtcctttaaatcctctggcgcctagccgaggcgaagatgatggagaatcattctacacatggctagaaggtttgtgtctggagaaaagagtcttctataagcttatatcgggacttcatgctagcatcaatttacatctatgcgcaaattatcttttggaagaaacctggggtaagcccagttggggacctaatattaaagaattcaaacaccgctttgaccctgtggaaaccaagggagaaggtccaagaaggctcaagaatctttactttttatacttgattgagcttcgagctttgtcaaaggtggctccatattttgagcgctcaattgtcgatctttacactggaaatgcagaagaagatgctgacacaaaaactcttctactgaatatctttcaagatacaaagtcctttcccatgcactttgatgagaaatccatgtttgcaggtgacaaaaaaggggccaagtcactaaaggaggaattccgattacatttcaagaatatctcccgtataatggactgtgttggatgtgacaaatgcagattatggggaaaattacagactcagggtttaggaactgccctgaagatattattctctgaaaaagaaatccaaaagcttccagagaatagtccatctaaaggcttccaactcacccgacaggaaatagttgctcttttaaatgcttttggaaggctttctacaagtataagagacttacagaattttaaagtcttattacaacagagtaggtaataaaggcttttatgtgtctaactagagacataaagtgactgtggaaagccttttaattatggacattcatcagaaggccaaacctgatacagcgtgaaagtctccctccccagtcgttaggttagttgctagtgg

SEQ ID NO: 344487 - DNA, 335 bp, Homo sapiens
gcagcacattctttgaactgtttgactctttaaaaattcttccttctctgaaagcaacattctgttccccagcagcctttcctcattagctttctctcttggggcctccaaagcaagtcttgtcccttttctacatagcagctttcctcagacttaaagacagcttcctaagaagaagggggtgggggggacctggggctaaggacacagcctggttaagctggaccggggcctttttatttttctgtcacacagcccagagccaaggggcttgttcaggcagctactttatgctgggaattcattttattttattatttttatttgtttcggga

SEQ ID NO: 344488 - DNA, 1044 bp, Homo sapiens
caaaagatttgaaaatgcagtcatcctactaccatcatgaaggacaaatatccaagggtaacagaaggcagaatgaaaggcctgagtccttgatgacattgttgaatcaccaaagcaacaccaggagaccctgcctccaaccatcttaagtaagatctacacaatatcttatcacacttaaactatgagcattgaaggagaatgcctttccacatgcagtgcaagaaacagaaaaagaatagccactggatcctatgtcatatgagctgcatttcagaggcggtcctgtgccataccatggagaaaggaatgctgcacagaggccaagatgaaatctccaccgacagaccttgctggattttcccactcagtctgtgactattagattatacccctttgtccaattgcatttgtacacagttgttcatgcttcagtcatgcctattcaatgaaatttccatagaaggcccaagaggaaagagtttgaagagcttccagaaaacggaacatgtggaggttcctggaagatagcaaggccggagagaacattgaagctttgtgagccttccctcatacctttccctatgcatctcttcatctgcaccctttggaatatcttttgtaataaacccgtttcctggagttcagtaagctgctctaacaagtttatcaaacccaaggagggggttgtgggaataccaatttacaggcggttggttagaagcacaagttaaacaacctggggcttgtgattgacattggaagtgggggcagtcttgtgcgactgggcctgtggaatctgatgctatccccagagaaatagtcagaagacaaatggaggacagcaagctggtgttggctgaataattgattgcttgcttgctggtagggagagatccctacacatcttgtcatataagtcttatgttgattgctgtgatgtgagagcagaggaaaaacagctggagttgtttttttttttcctaaccgtagtataaaatgtattcaaaatacaataaaaatattgctgaattaatatagtct

SEQ ID NO: 344489 - DNA, 660 bp, Homo sapiens
atcatccttgcttccaagtcaaactacaaattaaattcctcccaaagttagcttgggctgtaccctggataaaaccaaagacagcttggaggtcagaagcaagatggagtcaactaagtcaaacttctcttactatcatagttttgcaaaggtggtttcagataccttctattcttttcttttcaaccatttgtatcatcaaaacttaagtgtgtctctgtagacagcatatagttggatcttgtttcttccattctgacaatttctgccctttaattggattgtttaatccatttacattttttaatttttaagtaatggtgagtgttgggcctctcatgtacctatcacccaaatattgaatattgtatctatccatttacatttaatggttttaatattgttgatttacatctgccagtttactttttgttttctaaatggctccatgtctttttgttcctctagtcttcttttgctgctttttcatttgtgaatattgctagtgctatattttaactcctttggtgattgtttttcactatcctttttgttattttcttagtggcttctctagaggttaccttatacatcttaactaataagaatctagttcatatttatactaattcttacaagacacagaaaattttcttttat

SEQ ID NO: 344490 - DNA, 714 bp, Homo sapiens
atcatccttgcttccaagtcaaactacaaattaaattcctcccaaagttagcttgggctgtaccctggataaaaccaaagacagcttggaggtcagaagcaagatggagtcaactaagtcaaacttctcttactatcatagttttgcaaaggtggtttcagataccttctattcttttcttttcaaccatttgtatcatcaaaacttaagtgtgtctctgtagacagcatatagttggatcttgtttcttccattctgacaatttctgccctttaattggattgtttaatccatttacattttttaatttttaaaaaattattttagattcagggagtacatgtgcttattacttaagtattatgtgtgtaatggtgagtgttgggcctctcatgtacctatcacccaaatattgaatattgtatctatccatttacatttaatggttttaatattgttgatttacatctgccagtttactttttgttttctaaatggctccatgtctttttgttcctctagtcttcttttgctgctttttcatttgtgaatattgctagtgctatattttaactcctttggtgattgtttttcactatcctttttgttattttcttagtggcttctctagaggttaccttatacatcttaactaataagaatctagttcatatttatactaattcttacaagacacagaaaattttcttttat

SEQ ID NO: 344491 - DNA, 493 bp, Homo sapiens
atgcatgtcatctcttagataagtttttactgtcattgtgttgtgtgtagtgtaattaagagtttcaaatgattttaggactttagactatctttagcacggataagaaatgagcagctgagcagcttttcattgcttaaggattttgattaccgatttctatgaagattaaaatttgtaagaagacaatttaaggccaggcatggtggcacacgcctgtaatccagcactttgagaggccaaggaagaaggagccctttgagttcaggagtttgagactggcctggcaatgtagttagactttatctctacaaaaaaatcgaataattagccaagtgtagtggtgcacacctgtagtcccagggacttgagagactgaggcagaaagatggcttgcacccgggagatagaggctccagtgaactgtgatcatgccactgcactgcagcctgggtgacagagtgagctgctgccttaaaaggaaaaaaaaaaa

SEQ ID NO: 344492 - DNA, 247 bp, Homo sapiens
ctgacagtatgtatacagtcatgcgccacataatgacatttccacatttcagtcaatgatggactacatatatgacactgtcccataagattataatggagcattgggataaagtaagtacttgatggctctgaggaatctgtgtgacttgggcattgtggatccatacccaccattatgtgacattaaaggatcatatacagcacaattgaacataccatagtgttgggtccaacatgtaaagaag

SEQ ID NO: 344493 - DNA, 926 bp, Homo sapiens
tgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtctgcccagaactttgggatacttcgtggtggctctccgggatccaggtggccaccgtcctccctggctctctgtgttgcccactcctgaggccctggctcctggatgcttcagcctacgtgtgcctcctcgctctgttttcgtgggtgctac

SEQ ID NO: 344494 - DNA, 880 bp, Homo sapiens
tgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcgggtgtgtacagccgtgcaggcctcggggagggagggaggagggtgcgtgggcccgcggcctctgttctcagccaggagctgccgctgatcctgaaaactcacagctgcttttcttgttttaactgaggggatttcacacgatgtcactggtgacttaacaggaaggagaggcacagtgcacttccctagaggaggcctggaattctcttggctcccagaggtgtccctaggcagtccctcaggacccctatcctttaccagac

SEQ ID NO: 344495 - DNA, 794 bp, Homo sapiens
tggcttagcttaaaccaagtcttgtgtgcaaatgaacgtccttctgagcagctgtgctcgggctgttccagaagtaatgctgccaaggctcaggagtgccttccttccagtactcacagaaggactgaaaatggcgaccggatcgcttcccactgagtcaggctgctcataccttggtcttaagcaaaggtggtggttctcagcttggtcgcccaccttcttcccctgtctgggctccagatctgttttgctggttcccagcagcatgtctgttactgcggtgtgtgtggttctggcctgtgtggcctgagatccccttcccttgcctgtcctgcctgacagccctgtgcaggccattccaaggtgccttccaactggcctcggaccacgagaggtcggagctggagattcgaggaagaagccatagctgcctcctggggctgtgcttctcaccagtggggacccctgtgatttcttttcctgcctgggaccctggcttctgcacctggacttgcaccttcggcccccacacctgggggctagcagcttcctgcggtggctggccttcgggttgcttcactggtcctgagtcctggcttcttaccttcccctctgagtcccaccgtcctgatgagtgcacagaattctgtctgctttagacactcggagagacttccatttcccatgggccttgactgcagaagattcagagtgatttggcgcaggttctgaagtgctgatcggaagagcccagcatagatttagcgttgccagaaccacaaatatcgttccag

SEQ ID NO: 344496 - DNA, 575 bp, Homo sapiens
agggagtgtgtgctcttcagcgtctgctgccgggaagtcactctcagatgtgtgagggtgacccagcaaggccgggttccgcctcggcaggtgtgatgcttccacgagcctcccggcacctgctccttggtggtcctggaacgcggcgctgtgctgtccaggtctcagctgcgtctggtgctggcagggcgagagccgcacttgcgtgggtgaacatcagtgaggcgcactcgcgatggccgctcactaccgagttctgtcagccgaacaaggatgaggatctatcggaatcctctgtctccccacccacagtcactcacttaaggacctgcctggtcactgtccagggaggcccctaaagtggagcctcaggaagaggtgcaggctcagagctcctgaaggaggtccctgctgcagccgtgtcacagccggggtgaaggtttcgcccatggtctccacctcgggatcccgtccttgtcagagaagtgttccttggatgagcgcccagagggaggagcccatggccctttcttctgtgactgattaaaaatctcgatgaaacaagacagcccctg

SEQ ID NO: 344497 - DNA, 787 bp, Homo sapiens
tggcttagcttaaaccaagtcttgtgtgcaaatgaacgtccttctgagcagctgtgctcgggctgttccagaagtaatgctgccaaggctcaggagtgccttccttccagtactcacagaaggactgaaaatggcgaccggatcgcttcccactgagtcaggctgctcataccttggtcttaagcaaaggtggtggttctcagcttggtcgcccaccttcttcccctgtctgggctccagatctgttttgctggttcccagcagcatgtctgttactgcggtgtgtgtggttctggcctgtgtggcctgagatccccttcccttgcctgtcctgcctgacagccctgtgcaggccattccaaggtgccttccaactggcctcggaccacgagaggtcggagctggagattcgaggaagaagccatagctgcctcctggggctgtgcttctcaccagtggggacccctgtgatttcttttcctgcctgggaccctggcttctgcacctggacttgcaccttcggcccccacacctgggggctagcagcttcctgcggtggctggccttcgggttttttgagtgctcccgaattttgggttttgggcccccatatgaataaaaaaaaaaaaaaaatggtggctcttaatatcattgtccctacaatacaccagcatagctgggctttataaccctactgaaagggtagaaagctgagattcagggagatgaagtggctcctgaagtcacgaatgacagggaccaaaaccggggccagtaccacaaatag

SEQ ID NO: 344498 - DNA, 450 bp, Homo sapiens
tgtcatgaaggccgagtaactggagccgctctcatccctccaccaggagggacttcacttacatctttgggccaagctgctcaatgaaccgccaggaactgacctgctgactgcactctgccaggcttcccaatgctttcactcttatctaccctttggcacttcgtgggcagcctgcccacgaagtgagagcaggaatgttttgaccgagtctgcgaggatcgcccgtggcaaaatcacagacctggccaacctccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagatctttgctcctgacgtccctcagatgcacgtgattgaccacacttgtgggcag

SEQ ID NO: 344499 - DNA, 1610 bp, Homo sapiens
tgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccgaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgtta

SEQ ID NO: 344500 - DNA, 1926 bp, Homo sapiens
tgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgagtggacggagggggtgaggtcagctcccgcctccagagatcagccttcgctgttctctgcccaaggtcggcccctcttcctaggtccgctcccgccgccccacgtcggctccttcaccccaagtcagctcctgcggccaggtcggccccattttcccgggtcagcgcccgcggcccaggtcggcccctttccccccagtcaactcccgccgcccaggtcggcccctttcccccgggtcagctcccgctcctctcgcaggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgtta

SEQ ID NO: 344501 - DNA, 1511 bp, Homo sapiens
ccccacatgatgtatagtcggcgccgggtttatttcggccgggccttcgcttttcggtccgtgccccgcggtcacgttcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgtta

SEQ ID NO: 344502 - DNA, 1010 bp, Homo sapiens
tgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgtta

SEQ ID NO: 344503 - DNA, 1143 bp, Homo sapiens
tgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgagtggacggagggggtgaggtcagctcccgcctccagagatcagccttcgctgttctctgcccaaggtcggcccctcttcctaggtccgctcccgccgccccacgtcggctccttcaccccaagtcagctcctgcggccaggtcggccccattttcccgggtcagcgcccgcggcccaggtcggcccctttccccccagtcaactcccgccgcccaggtcggcccctttcccccgggtcagctcccgctcctctcgcaggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggtcactcacttaaggacctgcctggtcactgtccagggaggcccctaaagtggagcctcaggaagaggtgcaggctcagagctcctgaaggaggtccctgctgcagccgtgtcacagccggggtgaaggtttcgcccatggtctccacctcgggatcccgtccttgtcagagaagtgttccttggatgagcgcccagagggaggagcccatggccctttcttctgtgactgattaaaaatctcgatgaaacaagacagcccctg

SEQ ID NO: 344504 - DNA, 905 bp, Homo sapiens
tgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgtgcgtatttgagctccaaggtcttccgctttccatgtggagcagatgggaagggggtgcacctgtctgctgtccaatgtggtcagtggagcggcgatgggagggggtggtgataggagcagtctctgggtttagggtctgggcagggcacgtgcctgccctctgacttgggagctgttcttagggttgggtcttaggtagcgttgtagcgagccatgcttttgtttctgcttctctgctgcctcttctctcagcattcctggtacccagcagcttgtcagagtgggtttggggctccctcttatctcatcactgtgctgtaggtctcgtcacgttgaaatcagtctctgagtatttactccttgcaagtgccagttttt

SEQ ID NO: 344505 - DNA, 463 bp, Homo sapiens
tttgcagagcaagtaagatattaatatacattaggaatttgctcctggtacttagctaaaatcctgtttttaaaaatgtgttaacacaaatctgagtggggcacgttttgaagagttgtctctggttttcccccgtgcaggatcctggtgcacctgagccgtggaggggctgaagtccagatctttgctcctgacgtccctcagatgcacgtgattgaccacaccaaggggcagccgtccgaaggcgagagcaggtgtgggggtgggattggaacttgcttcttgtctacctcccacggtgcagcctttttttgctggcttagcttaaaccaagtcttgtgtgcaaatgaacgtccttctgagcagctgtgctcgggctgttccagaagtaatgctgccaaggctcaggagtgccttccttccagtactcacagaaggactgaaaatggcgaccggatcgctt

SEQ ID NO: 344506 - DNA, 1664 bp, Homo sapiens
tgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgtta

SEQ ID NO: 344507 - DNA, 1103 bp, Homo sapiens
tgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcgggtgtgatgcttccacgagcctcccggcacctgctccttggtggtcctggaacgcggcgctgtgctgtccaggtctcagctgcgtctggtgctggcagggcgagagccgcacttgcgtgggtgaacatcagtgaggcgcactcgcgatggccgctcactaccgagttctgtcagccgaacaaggatgaggatctatcggaatcctctgtctccccacccacagtcactcacttaaggacctgcctggtcactgtccagggaggcccctaaagtggagcctcaggaagaggtgcaggctcagagctcctgaaggaggtccctgctgcagccgtgtcacagccggggtgaaggtttcgcccatggtctccacctcgggatcccgtccttgtcagagaagtgttccttggatgagcgcccagagggaggagcccatggccctttcttctgtgactgattaaaaatctcgatgaaacaagacagcccctg

SEQ ID NO: 344508 - DNA, 933 bp, Homo sapiens
tgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgttattagactttgtgctgc

SEQ ID NO: 344509 - DNA, 2019 bp, Homo sapiens
tgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgttaaaaaaaaaaaaaaaaaaaaaaaaaaaaaaaaaaaaaaaaaaaaagggggcgcgcgcgcgcggccaaagagattctccccaagggggcgccacaaagatcccgcgcggcccccaggtttcggggagaaaaagggggccccaaaaaggggggagcgcgatatataaaaagagacagagagccagcgggcgcgggagaggttaacacaaagggcgcgcgcgggagcaggggggccaacacagcgcggccagagacaggggggagaaaaccttgggaggagagaggagcaacccctcttaacctccgcgaggggcggggcggggccaacatacgtgtggggaacacaaaaaccaaaccc

SEQ ID NO: 344510 - DNA, 1611 bp, Homo sapiens
tgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgtta

SEQ ID NO: 344511 - DNA, 1589 bp, Homo sapiens
tgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgtaagtcctcaggggcagctggtcctccaccccgggggcgaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgtta

SEQ ID NO: 344512 - DNA, 1571 bp, Homo sapiens
tgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgtta

SEQ ID NO: 344513 - DNA, 1168 bp, Homo sapiens
gtctgaggaggccttttgtctcccggtaggagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgtta

SEQ ID NO: 344514 - DNA, 1453 bp, Homo sapiens
ataggggcacgtgtcttgggtggtgtggaggcctggccagtggttacatgcatggtgttggggaggctcaggtctgtggctggccggccccagttgtgccacctgctgccctgttgcctgttgccctgccccatgaggaccggctccttcacggccagttcttcatctgaaaagcggaggtgctgccactgcctcccgtggtggttgtgagcaccccaggcatgtgtgcgcccccatggcggggcagctcgtggccatgtgtgggtgttgggcctgtgtgatgctggcatgaaaggtgccccgttccctggaatttcccgctgctttcttcctctagaatgcatgtgaattgggaacaggttccttcttatgttgttcagcagcataaatcatacagaaagcagggtcctgccggcacagactgcaccaggagcgagttctcctcttccaagttatctgagaacaaagttaggacacgcggtgagggtgggggaggggccggggctccacacctgaaagtccctcaggtccgtgctgggtggctttttccgtaactctgcacacgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagctcctcagcccccaggattgacctctggggagtgatggtagcgttggtgccaggccgtgggttcaggtgtggcagaagcttgcagatgcgtccgaagggaaataaagtgtgttggcgtta

SEQ ID NO: 344515 - DNA, 944 bp, Homo sapiens
  misc_feature (913)..(914): n is a, c, g, or t
tgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgccatnntgcgcttcgggatcctctagatcaacccgg

SEQ ID NO: 344516 - DNA, 881 bp, Homo sapiens
tgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggtcactcacttaaggacctgcctggtcactgtccagggaggcccctaaagtggagcctcaggaagaggtgcaggctcagagctcctgaaggaggtccctgctgcagccgtgtcacagccggggtgaaggtttcgcccatggtctccacctcgggatcccgtccttgtcagagaagtgttccttggatgagcgcccagagggaggagcccatggccctttcttctgtgactgattaaaaatctcgatgaaacaagacagcccctg

SEQ ID NO: 344517 - DNA, 869 bp, Homo sapiens
  misc_feature (838)..(839): n is a, c, g, or t
tgcgcaggcgcagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgtaagtcctcaggggcagctggtcctccaccccgggggcgaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgccatnntgcgcttcgggatcctctagatcaacccgg

SEQ ID NO: 344518 - DNA, 373 bp, Homo sapiens
aggtaaggggaagggacaagagggagaagatagcaaacctgaaagtaaataacgtgatatggtaaaataaatggacccaaaagtttatggaatatcataaaatagacagtgccaagggaatgtttgtgaccttgtcaatgtcctcaagaaagaaactgagttaagttagaacactaacttaagacaactgctatattctatattaacttagcactgaatatatattagatgtatattatatattatacataatatatattacattgatatatatttatatatcatatctataaagtgtatatatatattttagatagatagataaaattatctgtaattgaaggcctgagatagaacttgataaaacatatta

SEQ ID NO: 344519 - DNA, 921 bp, Homo sapiens
ccaaacaacttcgctaaaatacccagattcttttgcaatatcagtgtcttcgtcaccatataattttggctctgtttcctcctggcatttatcagctggaggggaaaacctgagaccaccccaggtgaccaccctcttcctcattcatctgtgctgtcacctgcctgctcctgtaggtatgtctgcttttagccttgatgtgtacaagaagctgacagaagggcctcgggtcttaatcacagacttagggaaatcataaggaaaagaggcatgaaggtgctaaaaaaatcttaaagacaacagtttgagaactcccaggagtcaatatccctatttccctgacccactgtgcccagccctcattattcaactggcaaacttcaccaacaaaccaaaacaaaagaaaaaattgtcatatttttgtttctatcattttttcctttagagcccacctagtcctatgtggcaataaatagacactactctaaatctcatctggccaactgagtttcaaaacctaatccagagagcctggaaagaaaatgcattgaaaagaaaaaaaaaagaaagaaaaagaaaatatgttgaatattgatgttataatttacatgtgagatttttctctttatgaatcatttttctgttcaggcaaagtggtctgttttccgattttgacattatgttatatgtatctgtgctaaaataagctgcaaatacttcaactagcagttgtcattctgtcagtctttttagaatccttaagttggcaaggtattgattagtgcctggatgcctccacacctaaattatatactgcagtgggaaactgctgtctcttagaattattcctttttttaaaggattattctttgtaacttcaaaaactctgatagcaacccattctttttttaatgtactcca

SEQ ID NO: 344520 - DNA, 445 bp, Homo sapiens
ggttgctttgtgtggtattgccatcttaatattaagtcttccaattgctgaacacaggatatctctatttatttatgtcttccttaattccattcagcaatgttttataacttttagtgtacaatgctttcacttggttaaatttattcctagggaccgggcgcagtaatcacacctataatcccagcactttgggaggccaaggtggccggatcacccaaggtcaggagtttgagaccagcctgaccaacatggagaaaccctgtctctactgaaagaaaatacagaattagccgggtgtggtggcacatgcctataatcccagctacttgggggagcaggggtgaggcaggagaatcacttgaacccgagaggtggaggttgcggtgagccaagatcacaccactgcactccagcctgggcaataagagcaagactccgtctc

SEQ ID NO: 344521 - DNA, 419 bp, Homo sapiens
atgtctatgtcctaatctccagaacctatgaatggattgtctttcatggaaaaggggtatttagattgctaatctactggccttgagatgggagagtatcctggatgatctttatgggcccaatgtgatcacaatggtccttaaaagtggaagaaggtgtccgaagaggaccagagagacacccatgtgagaaggactcggccttatgttgctggttttgaagacggagaaaggggccacaagcaaaggaaagtggggggcttctagaagctggaaaaggcaaggaaacggattctcccttatagcctccagaatggaacacagccctgccaaccccttgatcttagtcctgtgagacccctgttggacttttgactacagaactgtaaaagaataaatttgtgttgttttaagtcacc

SEQ ID NO: 344522 - DNA, 358 bp, Homo sapiens
ggataaaagactacaaatatggtgcagtgtatactgcttgggtgatgagtgcaccaaaatcccacaaatcaccactaaggaacttattcatgtaaccaaataccacctgttccccaattacctatggaaaaaaacacccaaaatgcttgggaacagaaatgttttggattttggatttttttttaaatattggaatatttgcgttatactcaccagttgagcatccctgatccaaaaatgagaaatccaaaatgtgccaatattcatttcctttgagcatgacctttgagcatcatatcggcactcgaagagttttgaactttggagtatttcagattttataaattttggattaggg

SEQ ID NO: 344523 - DNA, 8458 bp, Homo sapiens
  misc_feature (4013)..(4013): n is a, c, g, or t
gcggccgctcgcccggaccctgaggctgctgggcccaccctcccggaaccgtccgaccctcggtggcctcggcctcttctgccatctccggtcctaccctggggcggagggtggaaggcagcttccgtcgaagaggagggggctgcggtggccaccgcggcggagcccgagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcagataacaaagaaacccctcagacagagctgggatgattattgctatgactctgagccggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggacatgatgatacagcgccatgtgcaattttgaaaagtatggatagttttagctttctccaacacccagtccaccagaggagcttagagattctgcagagatgcaaggaagagaagtacagtataacccggaaaaatcccagaacacctctttctgatctccagggcatgaatgctctaaatgaaaaaaaccaacatgatacatttgatattgcctggaatggcagaactgggattcgccagagcagactatcaagtggcacctccttgcttgataaagatggaatatttgctaattcaactagcagcaaactcctggagagagcccatggaattctcacgagaaacaaaaatttcaaatccaagcctgcccttccaaagcacttgctagaagtaaattctttaaagcacctgacaagactgacactacaagatcgcattaccaagtctcttcttcatttacacaagaagaaaaaacctcccagcatcagtgcccagtttcaggcatcattaagcaagctaatggaaacacttggtcaagcagaaccatattttgtaaaatgcattcgctctaatgctgaaaagctgcccttaaggttcagtgatgtcttggtacttagacagcttcgatacaccgggatgctggaaacagttcaaattcgccaatcaggatacagctccaaatattctttccaggattttgtgagccacttccatgtacttcttccccgaaatattattccatccaaatttaacattcaggatttcttcaggaaaataaatcttaatccagataattatcaagttggaaaaaccatggtctttctaaaggagcaggaacgacagcacttacaagatctgcttcaccaagaggtgctccgcagaatcatattgttgcagcgatggttcagggtcttgctgtgtaggcagcatttcctccatctgagacaagcatctgttattatccagagattctggaggaattacctaaatcagaagcaagtcagagatgcagctgtgcagaaggatgcttttgttatggctagtgcagctgctcttctccaagcttcctggcgtgctcacttagagaggcagcggtacttggagttacgggctgcagccatcgttatccagcagaaatggagagattactataggcgcaggcacatggctgctatttgcatacaagcaagatggaaagcctacagggaaagtaaaaggtaccaagaacaaaggaaaaaaattatccttttgcaatcaacatgtagaggattcagagcaagacaaagatttaaagctttaaaagaacaaaggctaagagaaacaaagccagaagttggattggtgaatattaagggatatggatctctggaaattcagggttcagacccttcagaatgggaggattgttcttttgacaacagaataaaagccatagaggaatgtaaatctgtaatagagagtaatcgaattagccgtgaaagttcagtggactgcttgaaggagtcaccaaacaagcagcaggagagagcccaaagccagagtggtgtggacttgcaggaagatgtgcttgtaagagagagacccagntccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggacaatatgagtattccccttgtcagcaaagaagccttaaacagtaaaaatcctcaactccataaagaagatgaaccagcatggaaacctgtgaagttagctgggccaggccaaagagagacatcacagcgattttcgtcagttgatgaacaagcaaaacttcataagactatgtctcaaggagagattaccaagttggcagtgagacagaaggcttcagattcagatataagacctcagagagctaagatgagattctgggccaaagggaaacaaggggagaagaagactaccagagtgaaacctactacccagtcagaggtttcgccactctttgcaggcacagatgtgattccagctcatcagtttccagatgaattagctgcatatcacccaacacctcctttgagcccagaactgcccggcagttgccggaaggaattcaaagagaacaaagaaccttctccaaaggctaagcgcaagcgaagtgtgaagattagcaacgtggctttggattctatgcattggcaaaatgactctgtccagatcatagcaagtgtcagtgatttaaaaagcatggatgaatttcttctgaaaaaggtgaatgacctagataatgaagacagcaagaaggatacactagtggatgttgtatttaaaaaagccctgaaggaatttcggcagaatatcttcagcttttattcatctgcattggcgatggatgatgggaaaagcatacggtataaagacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgccaaaaacagaaagaaagaaaagaaggaaaaaggaaactgatttggtggaagaacacaatggtcacatctttaaagccacccaatatagcatccctacatactgtgaatactgttcttctttgatatggataatggaccgagcctctgtttgcaaattatgcaagtatgcttgccataagaagtgctgtctgaaaaccacagccaagtgctctaaaaagtatgatccagagctgtcatctcgacaatttggggttgaactgtcccgtttgaccagtgaagaccgaactgttcctttagtagtggaaaagctcataaactacattgaaatgcatggactgtatacagaaggtatttatcgaaagtctggttcgactaataaaatcaaggagcttcggcagggtctagatacagatgctgagagtgtaaatctagatgactataacatacacgtcattgcaagtgtattcaaacaatggcttcgagatttgcccaatcctctcatgacctttgaactctatgaggaatttcttcgagctatgggccttcaggagaggaaggagacaatccgtggtgtatactctgtgattgatcaactctcccgaactcatctcaatacactggaacgcctcatctttcatctagtcaggattgctctgcaggaagacactaatcgaatgtctgctaatgctttggccattgtgtttgcgccctgcattctccgctgccctgacaccactgacccactacaaagtgtacaggacatcagtaagactaccacttgtgtggaactgattgttgtggaacaaatgaataaatacaaggctcgtctcaaagatatcagtagcttggaatttgctgagaataaggcaaagaccaggttgtcactgattcgtagatcaatgggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaaggaggagctaacatttgagatgcttgtactggaaccccgtgcctctgatgatgaaacccttgagtctgaggcctccattgggactgctgatagctcagagaatttgaatatggagtctgaatatgctatctctgagaaatcagaaagaagcttagcccttagctccctgaagacagctggcaagtctgaaccttccagcaagttgcgaaagcaacttaaaaagcagcaagactctttagatgtcgtggactcttcggtctcctctttatgtctgtctaacacggcatcatctcatgggaccagaaaactatttcagatttattccaaatctccattctaccgagctgcctcaggtaatgaggccctgggaatggaaggaccattgggccagaccaaattcctggaagacaagcctcagttcatcagcagaggaaccttcaacccggaaaagggcaaacaaaaattaaagaatgtgaaaaactcacctcagaaaaccaaagagaccccagaggggacagtcatgtctggccgcagaaaaactgtggacccagactgcacctccaaccaacagctagcactctttggaaataatgaatttatggtctgaaccggcagatgtgtgtccctccgtggctacagagtggtaaacaaatctcacctttggggctgcgtttcatcacctcgtccacaatagtcaatcctaattgtggtcctgcctcttttctaagcatatggctaagactgtatgtgctgaattcctgggcctcctgcagaagcagaaagcctgctggggatggtgccagctgtgccttggctgttgtatttgaattgagatttttactatacaaagccacctagggcctggggatttgggtcagttgtagttgcctctcccccaccctcttttcccttcccaaaggtgggtgttgaactaggggggatattgctgtcctgagggaccctctcatttctgacatttgaagaaaacgtataaatctttcttaaccgtgaaagcaaaagcctttgggtttattttgggatagttaggagctagggtagaatataatttttttccaaaaacttacttacaaacaaaaagcctaatccctctattttaagatttctgaaaaaacactccatgttatattctggggaaagcaaaaacaaaaaaaaaaa

SEQ ID NO: 344524 - DNA, 440 bp, Homo sapiens
atcataaattattttgagaatctgatgaaagctgacactgttgttgtaaaatgtacatccttaacaatttgcatataaatgcaggaatttatggtgcccctgaagcctatccatggaccttacttaaaacttttgctttgtaacactatttttatagctcttcattttgtatatatcagtgatctctaatcttattaaattatgcatacttatcagatgcatagtatttaattttcagtgtatttcctctgtatagtttatatctgtactatactattaagttttttaattgtaaatctaaacaatttaaaaatataaaaatttgagataaagatgagataaattatatttgaaacaaattatttaaaattaaagactcaaccttggctctcaccagaaagaaatagttacttataacttttttgaaggggagagtcgtg

SEQ ID NO: 344525 - DNA, 8674 bp, Homo sapiens
  misc_feature (4013)..(4013): n is a, c, g, or t
gcggccgctcgcccggaccctgaggctgctgggcccaccctcccggaaccgtccgaccctcggtggcctcggcctcttctgccatctccggtcctaccctggggcggagggtggaaggcagcttccgtcgaagaggagggggctgcggtggccaccgcggcggagcccgagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcagataacaaagaaacccctcagacagagctgggatgattattgctatgactctgagccggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggacatgatgatacagcgccatgtgcaattttgaaaagtatggatagttttagctttctccaacacccagtccaccagaggagcttagagattctgcagagatgcaaggaagagaagtacagtataacccggaaaaatcccagaacacctctttctgatctccagggcatgaatgctctaaatgaaaaaaaccaacatgatacatttgatattgcctggaatggcagaactgggattcgccagagcagactatcaagtggcacctccttgcttgataaagatggaatatttgctaattcaactagcagcaaactcctggagagagcccatggaattctcacgagaaacaaaaatttcaaatccaagcctgcccttccaaagcacttgctagaagtaaattctttaaagcacctgacaagactgacactacaagatcgcattaccaagtctcttcttcatttacacaagaagaaaaaacctcccagcatcagtgcccagtttcaggcatcattaagcaagctaatggaaacacttggtcaagcagaaccatattttgtaaaatgcattcgctctaatgctgaaaagctgcccttaaggttcagtgatgtcttggtacttagacagcttcgatacaccgggatgctggaaacagttcaaattcgccaatcaggatacagctccaaatattctttccaggattttgtgagccacttccatgtacttcttccccgaaatattattccatccaaatttaacattcaggatttcttcaggaaaataaatcttaatccagataattatcaagttggaaaaaccatggtctttctaaaggagcaggaacgacagcacttacaagatctgcttcaccaagaggtgctccgcagaatcatattgttgcagcgatggttcagggtcttgctgtgtaggcagcatttcctccatctgagacaagcatctgttattatccagagattctggaggaattacctaaatcagaagcaagtcagagatgcagctgtgcagaaggatgcttttgttatggctagtgcagctgctcttctccaagcttcctggcgtgctcacttagagaggcagcggtacttggagttacgggctgcagccatcgttatccagcagaaatggagagattactataggcgcaggcacatggctgctatttgcatacaagcaagatggaaagcctacagggaaagtaaaaggtaccaagaacaaaggaaaaaaattatccttttgcaatcaacatgtagaggattcagagcaagacaaagatttaaagctttaaaagaacaaaggctaagagaaacaaagccagaagttggattggtgaatattaagggatatggatctctggaaattcagggttcagacccttcagaatgggaggattgttcttttgacaacagaataaaagccatagaggaatgtaaatctgtaatagagagtaatcgaattagccgtgaaagttcagtggactgcttgaaggagtcaccaaacaagcagcaggagagagcccaaagccagagtggtgtggacttgcaggaagatgtgcttgtaagagagagacccagntccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggacaatatgagtattccccttgtcagcaaagaagccttaaacagtaaaaatcctcaactccataaagaagatgaaccagcatggaaacctgtgaagttagctgggccaggccaaagagagcaggttgccagaccggcccataaaaagaaagctcgaatggcgcggacgcgctccgatttcttgactagaggtacttttgccgatggggagggggatacagaggaagatgattacgatgacattattgagccccttctctcccttgaccaagcttctcactgtgagctagggcctgcacccagcctgggtcaggcctctcacagtgactccgaaatgacatcacagcgattttcgtcagttgatgaacaagcaaaacttcataagactatgtctcaaggagagattaccaagttggcagtgagacagaaggcttcagattcagatataagacctcagagagctaagatgagattctgggccaaagggaaacaaggggagaagaagactaccagagtgaaacctactacccagtcagaggtttcgccactctttgcaggcacagatgtgattccagctcatcagtttccagatgaattagctgcatatcacccaacacctcctttgagcccagaactgcccggcagttgccggaaggaattcaaagagaacaaagaaccttctccaaaggctaagcgcaagcgaagtgtgaagattagcaacgtggctttggattctatgcattggcaaaatgactctgtccagatcatagcaagtgtcagtgatttaaaaagcatggatgaatttcttctgaaaaaggtgaatgacctagataatgaagacagcaagaaggatacactagtggatgttgtatttaaaaaagccctgaaggaatttcggcagaatatcttcagcttttattcatctgcattggcgatggatgatgggaaaagcatacggtataaagacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgccaaaaacagaaagaaagaaaagaaggaaaaaggaaactgatttggtggaagaacacaatggtcacatctttaaagccacccaatatagcatccctacatactgtgaatactgttcttctttgatatggataatggaccgagcctctgtttgcaaattatgcaagtatgcttgccataagaagtgctgtctgaaaaccacagccaagtgctctaaaaagtatgatccagagctgtcatctcgacaatttggggttgaactgtcccgtttgaccagtgaagaccgaactgttcctttagtagtggaaaagctcataaactacattgaaatgcatggactgtatacagaaggtatttatcgaaagtctggttcgactaataaaatcaaggagcttcggcagggtctagatacagatgctgagagtgtaaatctagatgactataacatacacgtcattgcaagtgtattcaaacaatggcttcgagatttgcccaatcctctcatgacctttgaactctatgaggaatttcttcgagctatgggccttcaggagaggaaggagacaatccgtggtgtatactctgtgattgatcaactctcccgaactcatctcaatacactggaacgcctcatctttcatctagtcaggattgctctgcaggaagacactaatcgaatgtctgctaatgctttggccattgtgtttgcgccctgcattctccgctgccctgacaccactgacccactacaaagtgtacaggacatcagtaagactaccacttgtgtggaactgattgttgtggaacaaatgaataaatacaaggctcgtctcaaagatatcagtagcttggaatttgctgagaataaggcaaagaccaggttgtcactgattcgtagatcaatgggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaaggaggagctaacatttgagatgcttgtactggaaccccgtgcctctgatgatgaaacccttgagtctgaggcctccattgggactgctgatagctcagagaatttgaatatggagtctgaatatgctatctctgagaaatcagaaagaagcttagcccttagctccctgaagacagctggcaagtctgaaccttccagcaagttgcgaaagcaacttaaaaagcagcaagactctttagatgtcgtggactcttcggtctcctctttatgtctgtctaacacggcatcatctcatgggaccagaaaactatttcagatttattccaaatctccattctaccgagctgcctcaggtaatgaggccctgggaatggaaggaccattgggccagaccaaattcctggaagacaagcctcagttcatcagcagaggaaccttcaacccggaaaagggcaaacaaaaattaaagaatgtgaaaaactcacctcagaaaaccaaagagaccccagaggggacagtcatgtctggccgcagaaaaactgtggacccagactgcacctccaaccaacagctagcactctttggaaataatgaatttatggtctgaaccggcagatgtgtgtccctccgtggctacagagtggtaaacaaatctcacctttggggctgcgtttcatcacctcgtccacaatagtcaatcctaattgtggtcctgcctcttttctaagcatatggctaagactgtatgtgctgaattcctgggcctcctgcagaagcagaaagcctgctggggatggtgccagctgtgccttggctgttgtatttgaattgagatttttactatacaaagccacctagggcctggggatttgggtcagttgtagttgcctctcccccaccctcttttcccttcccaaaggtgggtgttgaactaggggggatattgctgtcctgagggaccctctcatttctgacatttgaagaaaacgtataaatctttcttaaccgtgaaagcaaaagcctttgggtttattttgggatagttaggagctagggtagaatataatttttttccaaaaacttacttacaaacaaaaagcctaatccctctattttaagatttctgaaaaaacactccatgttatattctggggaaagcaaaaacaaaaaaaaaaa

SEQ ID NO: 344526 - DNA, 8636 bp, Homo sapiens
  misc_feature (3975)..(3975): n is a, c, g, or t
gcggccgctcgcccggaccctgaggctgctgggcccaccctcccggaaccgtccgaccctcggtggcctcggcctcttctgccatctccggtcctaccctggggctgcggtggccaccgcggcggagcccgagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcagataacaaagaaacccctcagacagagctgggatgattattgctatgactctgagccggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggacatgatgatacagcgccatgtgcaattttgaaaagtatggatagttttagctttctccaacacccagtccaccagaggagcttagagattctgcagagatgcaaggaagagaagtacagtataacccggaaaaatcccagaacacctctttctgatctccagggcatgaatgctctaaatgaaaaaaaccaacatgatacatttgatattgcctggaatggcagaactgggattcgccagagcagactatcaagtggcacctccttgcttgataaagatggaatatttgctaattcaactagcagcaaactcctggagagagcccatggaattctcacgagaaacaaaaatttcaaatccaagcctgcccttccaaagcacttgctagaagtaaattctttaaagcacctgacaagactgacactacaagatcgcattaccaagtctcttcttcatttacacaagaagaaaaaacctcccagcatcagtgcccagtttcaggcatcattaagcaagctaatggaaacacttggtcaagcagaaccatattttgtaaaatgcattcgctctaatgctgaaaagctgcccttaaggttcagtgatgtcttggtacttagacagcttcgatacaccgggatgctggaaacagttcaaattcgccaatcaggatacagctccaaatattctttccaggattttgtgagccacttccatgtacttcttccccgaaatattattccatccaaatttaacattcaggatttcttcaggaaaataaatcttaatccagataattatcaagttggaaaaaccatggtctttctaaaggagcaggaacgacagcacttacaagatctgcttcaccaagaggtgctccgcagaatcatattgttgcagcgatggttcagggtcttgctgtgtaggcagcatttcctccatctgagacaagcatctgttattatccagagattctggaggaattacctaaatcagaagcaagtcagagatgcagctgtgcagaaggatgcttttgttatggctagtgcagctgctcttctccaagcttcctggcgtgctcacttagagaggcagcggtacttggagttacgggctgcagccatcgttatccagcagaaatggagagattactataggcgcaggcacatggctgctatttgcatacaagcaagatggaaagcctacagggaaagtaaaaggtaccaagaacaaaggaaaaaaattatccttttgcaatcaacatgtagaggattcagagcaagacaaagatttaaagctttaaaagaacaaaggctaagagaaacaaagccagaagttggattggtgaatattaagggatatggatctctggaaattcagggttcagacccttcagaatgggaggattgttcttttgacaacagaataaaagccatagaggaatgtaaatctgtaatagagagtaatcgaattagccgtgaaagttcagtggactgcttgaaggagtcaccaaacaagcagcaggagagagcccaaagccagagtggtgtggacttgcaggaagatgtgcttgtaagagagagacccagntccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggacaatatgagtattccccttgtcagcaaagaagccttaaacagtaaaaatcctcaactccataaagaagatgaaccagcatggaaacctgtgaagttagctgggccaggccaaagagagcaggttgccagaccggcccataaaaagaaagctcgaatggcgcggacgcgctccgatttcttgactagaggtacttttgccgatggggagggggatacagaggaagatgattacgatgacattattgagccccttctctcccttgaccaagcttctcactgtgagctagggcctgcacccagcctgggtcaggcctctcacagtgactccgaaatgacatcacagcgattttcgtcagttgatgaacaagcaaaacttcataagactatgtctcaaggagagattaccaagttggcagtgagacagaaggcttcagattcagatataagacctcagagagctaagatgagattctgggccaaagggaaacaaggggagaagaagactaccagagtgaaacctactacccagtcagaggtttcgccactctttgcaggcacagatgtgattccagctcatcagtttccagatgaattagctgcatatcacccaacacctcctttgagcccagaactgcccggcagttgccggaaggaattcaaagagaacaaagaaccttctccaaaggctaagcgcaagcgaagtgtgaagattagcaacgtggctttggattctatgcattggcaaaatgactctgtccagatcatagcaagtgtcagtgatttaaaaagcatggatgaatttcttctgaaaaaggtgaatgacctagataatgaagacagcaagaaggatacactagtggatgttgtatttaaaaaagccctgaaggaatttcggcagaatatcttcagcttttattcatctgcattggcgatggatgatgggaaaagcatacggtataaagacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgccaaaaacagaaagaaagaaaagaaggaaaaaggaaactgatttggtggaagaacacaatggtcacatctttaaagccacccaatatagcatccctacatactgtgaatactgttcttctttgatatggataatggaccgagcctctgtttgcaaattatgcaagtatgcttgccataagaagtgctgtctgaaaaccacagccaagtgctctaaaaagtatgatccagagctgtcatctcgacaatttggggttgaactgtcccgtttgaccagtgaagaccgaactgttcctttagtagtggaaaagctcataaactacattgaaatgcatggactgtatacagaaggtatttatcgaaagtctggttcgactaataaaatcaaggagcttcggcagggtctagatacagatgctgagagtgtaaatctagatgactataacatacacgtcattgcaagtgtattcaaacaatggcttcgagatttgcccaatcctctcatgacctttgaactctatgaggaatttcttcgagctatgggccttcaggagaggaaggagacaatccgtggtgtatactctgtgattgatcaactctcccgaactcatctcaatacactggaacgcctcatctttcatctagtcaggattgctctgcaggaagacactaatcgaatgtctgctaatgctttggccattgtgtttgcgccctgcattctccgctgccctgacaccactgacccactacaaagtgtacaggacatcagtaagactaccacttgtgtggaactgattgttgtggaacaaatgaataaatacaaggctcgtctcaaagatatcagtagcttggaatttgctgagaataaggcaaagaccaggttgtcactgattcgtagatcaatgggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaaggaggagctaacatttgagatgcttgtactggaaccccgtgcctctgatgatgaaacccttgagtctgaggcctccattgggactgctgatagctcagagaatttgaatatggagtctgaatatgctatctctgagaaatcagaaagaagcttagcccttagctccctgaagacagctggcaagtctgaaccttccagcaagttgcgaaagcaacttaaaaagcagcaagactctttagatgtcgtggactcttcggtctcctctttatgtctgtctaacacggcatcatctcatgggaccagaaaactatttcagatttattccaaatctccattctaccgagctgcctcaggtaatgaggccctgggaatggaaggaccattgggccagaccaaattcctggaagacaagcctcagttcatcagcagaggaaccttcaacccggaaaagggcaaacaaaaattaaagaatgtgaaaaactcacctcagaaaaccaaagagaccccagaggggacagtcatgtctggccgcagaaaaactgtggacccagactgcacctccaaccaacagctagcactctttggaaataatgaatttatggtctgaaccggcagatgtgtgtccctccgtggctacagagtggtaaacaaatctcacctttggggctgcgtttcatcacctcgtccacaatagtcaatcctaattgtggtcctgcctcttttctaagcatatggctaagactgtatgtgctgaattcctgggcctcctgcagaagcagaaagcctgctggggatggtgccagctgtgccttggctgttgtatttgaattgagatttttactatacaaagccacctagggcctggggatttgggtcagttgtagttgcctctcccccaccctcttttcccttcccaaaggtgggtgttgaactaggggggatattgctgtcctgagggaccctctcatttctgacatttgaagaaaacgtataaatctttcttaaccgtgaaagcaaaagcctttgggtttattttgggatagttaggagctagggtagaatataatttttttccaaaaacttacttacaaacaaaaagcctaatccctctattttaagatttctgaaaaaacactccatgttatattctggggaaagcaaaaacaaaaaaaaaaa

SEQ ID NO: 344527 - DNA, 8554 bp, Homo sapiens
  misc_feature (3893)..(3893): n is a, c, g, or t
gcggccgctcgcccggaccctgaggctgctgggcccaccctcccggaaccgtccgaccctcggtggcctcggcctcttctgccatctccggtcctaccctggggcggagggtggaaggcagcttccgtcgaagaggagggggctgcggtggccaccgcggcggagcccgagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcagataacaaagaaacccctcagacagagctgggatgattattgctatgactctgagccggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggtataacccggaaaaatcccagaacacctctttctgatctccagggcatgaatgctctaaatgaaaaaaaccaacatgatacatttgatattgcctggaatggcagaactgggattcgccagagcagactatcaagtggcacctccttgcttgataaagatggaatatttgctaattcaactagcagcaaactcctggagagagcccatggaattctcacgagaaacaaaaatttcaaatccaagcctgcccttccaaagcacttgctagaagtaaattctttaaagcacctgacaagactgacactacaagatcgcattaccaagtctcttcttcatttacacaagaagaaaaaacctcccagcatcagtgcccagtttcaggcatcattaagcaagctaatggaaacacttggtcaagcagaaccatattttgtaaaatgcattcgctctaatgctgaaaagctgcccttaaggttcagtgatgtcttggtacttagacagcttcgatacaccgggatgctggaaacagttcaaattcgccaatcaggatacagctccaaatattctttccaggattttgtgagccacttccatgtacttcttccccgaaatattattccatccaaatttaacattcaggatttcttcaggaaaataaatcttaatccagataattatcaagttggaaaaaccatggtctttctaaaggagcaggaacgacagcacttacaagatctgcttcaccaagaggtgctccgcagaatcatattgttgcagcgatggttcagggtcttgctgtgtaggcagcatttcctccatctgagacaagcatctgttattatccagagattctggaggaattacctaaatcagaagcaagtcagagatgcagctgtgcagaaggatgcttttgttatggctagtgcagctgctcttctccaagcttcctggcgtgctcacttagagaggcagcggtacttggagttacgggctgcagccatcgttatccagcagaaatggagagattactataggcgcaggcacatggctgctatttgcatacaagcaagatggaaagcctacagggaaagtaaaaggtaccaagaacaaaggaaaaaaattatccttttgcaatcaacatgtagaggattcagagcaagacaaagatttaaagctttaaaagaacaaaggctaagagaaacaaagccagaagttggattggtgaatattaagggatatggatctctggaaattcagggttcagacccttcagaatgggaggattgttcttttgacaacagaataaaagccatagaggaatgtaaatctgtaatagagagtaatcgaattagccgtgaaagttcagtggactgcttgaaggagtcaccaaacaagcagcaggagagagcccaaagccagagtggtgtggacttgcaggaagatgtgcttgtaagagagagacccagntccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggacaatatgagtattccccttgtcagcaaagaagccttaaacagtaaaaatcctcaactccataaagaagatgaaccagcatggaaacctgtgaagttagctgggccaggccaaagagagcaggttgccagaccggcccataaaaagaaagctcgaatggcgcggacgcgctccgatttcttgactagaggtacttttgccgatggggagggggatacagaggaagatgattacgatgacattattgagccccttctctcccttgaccaagcttctcactgtgagctagggcctgcacccagcctgggtcaggcctctcacagtgactccgaaatgacatcacagcgattttcgtcagttgatgaacaagcaaaacttcataagactatgtctcaaggagagattaccaagttggcagtgagacagaaggcttcagattcagatataagacctcagagagctaagatgagattctgggccaaagggaaacaaggggagaagaagactaccagagtgaaacctactacccagtcagaggtttcgccactctttgcaggcacagatgtgattccagctcatcagtttccagatgaattagctgcatatcacccaacacctcctttgagcccagaactgcccggcagttgccggaaggaattcaaagagaacaaagaaccttctccaaaggctaagcgcaagcgaagtgtgaagattagcaacgtggctttggattctatgcattggcaaaatgactctgtccagatcatagcaagtgtcagtgatttaaaaagcatggatgaatttcttctgaaaaaggtgaatgacctagataatgaagacagcaagaaggatacactagtggatgttgtatttaaaaaagccctgaaggaatttcggcagaatatcttcagcttttattcatctgcattggcgatggatgatgggaaaagcatacggtataaagacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgccaaaaacagaaagaaagaaaagaaggaaaaaggaaactgatttggtggaagaacacaatggtcacatctttaaagccacccaatatagcatccctacatactgtgaatactgttcttctttgatatggataatggaccgagcctctgtttgcaaattatgcaagtatgcttgccataagaagtgctgtctgaaaaccacagccaagtgctctaaaaagtatgatccagagctgtcatctcgacaatttggggttgaactgtcccgtttgaccagtgaagaccgaactgttcctttagtagtggaaaagctcataaactacattgaaatgcatggactgtatacagaaggtatttatcgaaagtctggttcgactaataaaatcaaggagcttcggcagggtctagatacagatgctgagagtgtaaatctagatgactataacatacacgtcattgcaagtgtattcaaacaatggcttcgagatttgcccaatcctctcatgacctttgaactctatgaggaatttcttcgagctatgggccttcaggagaggaaggagacaatccgtggtgtatactctgtgattgatcaactctcccgaactcatctcaatacactggaacgcctcatctttcatctagtcaggattgctctgcaggaagacactaatcgaatgtctgctaatgctttggccattgtgtttgcgccctgcattctccgctgccctgacaccactgacccactacaaagtgtacaggacatcagtaagactaccacttgtgtggaactgattgttgtggaacaaatgaataaatacaaggctcgtctcaaagatatcagtagcttggaatttgctgagaataaggcaaagaccaggttgtcactgattcgtagatcaatgggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaaggaggagctaacatttgagatgcttgtactggaaccccgtgcctctgatgatgaaacccttgagtctgaggcctccattgggactgctgatagctcagagaatttgaatatggagtctgaatatgctatctctgagaaatcagaaagaagcttagcccttagctccctgaagacagctggcaagtctgaaccttccagcaagttgcgaaagcaacttaaaaagcagcaagactctttagatgtcgtggactcttcggtctcctctttatgtctgtctaacacggcatcatctcatgggaccagaaaactatttcagatttattccaaatctccattctaccgagctgcctcaggtaatgaggccctgggaatggaaggaccattgggccagaccaaattcctggaagacaagcctcagttcatcagcagaggaaccttcaacccggaaaagggcaaacaaaaattaaagaatgtgaaaaactcacctcagaaaaccaaagagaccccagaggggacagtcatgtctggccgcagaaaaactgtggacccagactgcacctccaaccaacagctagcactctttggaaataatgaatttatggtctgaaccggcagatgtgtgtccctccgtggctacagagtggtaaacaaatctcacctttggggctgcgtttcatcacctcgtccacaatagtcaatcctaattgtggtcctgcctcttttctaagcatatggctaagactgtatgtgctgaattcctgggcctcctgcagaagcagaaagcctgctggggatggtgccagctgtgccttggctgttgtatttgaattgagatttttactatacaaagccacctagggcctggggatttgggtcagttgtagttgcctctcccccaccctcttttcccttcccaaaggtgggtgttgaactaggggggatattgctgtcctgagggaccctctcatttctgacatttgaagaaaacgtataaatctttcttaaccgtgaaagcaaaagcctttgggtttattttgggatagttaggagctagggtagaatataatttttttccaaaaacttacttacaaacaaaaagcctaatccctctattttaagatttctgaaaaaacactccatgttatattctggggaaagcaaaaacaaaaaaaaaaa

SEQ ID NO: 344528 - DNA, 8719 bp, Homo sapiens
  misc_feature (4058)..(4058): n is a, c, g, or t
gcggccgctcgcccggaccctgaggctgctgggcccaccctcccggaaccgtccgaccctcggtggcctcggcctcttctgccatctccggtcctaccctggggcggagggtggaaggcagcttccgtcgaagaggagggggctgcggtggccaccgcggcggagcccgaggcagaaggagtctctccctgtggctaccacctccccaggcctgtgttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcagataacaaagaaacccctcagacagagctgggatgattattgctatgactctgagccggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggacatgatgatacagcgccatgtgcaattttgaaaagtatggatagttttagctttctccaacacccagtccaccagaggagcttagagattctgcagagatgcaaggaagagaagtacagtataacccggaaaaatcccagaacacctctttctgatctccagggcatgaatgctctaaatgaaaaaaaccaacatgatacatttgatattgcctggaatggcagaactgggattcgccagagcagactatcaagtggcacctccttgcttgataaagatggaatatttgctaattcaactagcagcaaactcctggagagagcccatggaattctcacgagaaacaaaaatttcaaatccaagcctgcccttccaaagcacttgctagaagtaaattctttaaagcacctgacaagactgacactacaagatcgcattaccaagtctcttcttcatttacacaagaagaaaaaacctcccagcatcagtgcccagtttcaggcatcattaagcaagctaatggaaacacttggtcaagcagaaccatattttgtaaaatgcattcgctctaatgctgaaaagctgcccttaaggttcagtgatgtcttggtacttagacagcttcgatacaccgggatgctggaaacagttcaaattcgccaatcaggatacagctccaaatattctttccaggattttgtgagccacttccatgtacttcttccccgaaatattattccatccaaatttaacattcaggatttcttcaggaaaataaatcttaatccagataattatcaagttggaaaaaccatggtctttctaaaggagcaggaacgacagcacttacaagatctgcttcaccaagaggtgctccgcagaatcatattgttgcagcgatggttcagggtcttgctgtgtaggcagcatttcctccatctgagacaagcatctgttattatccagagattctggaggaattacctaaatcagaagcaagtcagagatgcagctgtgcagaaggatgcttttgttatggctagtgcagctgctcttctccaagcttcctggcgtgctcacttagagaggcagcggtacttggagttacgggctgcagccatcgttatccagcagaaatggagagattactataggcgcaggcacatggctgctatttgcatacaagcaagatggaaagcctacagggaaagtaaaaggtaccaagaacaaaggaaaaaaattatccttttgcaatcaacatgtagaggattcagagcaagacaaagatttaaagctttaaaagaacaaaggctaagagaaacaaagccagaagttggattggtgaatattaagggatatggatctctggaaattcagggttcagacccttcagaatgggaggattgttcttttgacaacagaataaaagccatagaggaatgtaaatctgtaatagagagtaatcgaattagccgtgaaagttcagtggactgcttgaaggagtcaccaaacaagcagcaggagagagcccaaagccagagtggtgtggacttgcaggaagatgtgcttgtaagagagagacccagntccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggacaatatgagtattccccttgtcagcaaagaagccttaaacagtaaaaatcctcaactccataaagaagatgaaccagcatggaaacctgtgaagttagctgggccaggccaaagagagcaggttgccagaccggcccataaaaagaaagctcgaatggcgcggacgcgctccgatttcttgactagaggtacttttgccgatggggagggggatacagaggaagatgattacgatgacattattgagccccttctctcccttgaccaagcttctcactgtgagctagggcctgcacccagcctgggtcaggcctctcacagtgactccgaaatgacatcacagcgattttcgtcagttgatgaacaagcaaaacttcataagactatgtctcaaggagagattaccaagttggcagtgagacagaaggcttcagattcagatataagacctcagagagctaagatgagattctgggccaaagggaaacaaggggagaagaagactaccagagtgaaacctactacccagtcagaggtttcgccactctttgcaggcacagatgtgattccagctcatcagtttccagatgaattagctgcatatcacccaacacctcctttgagcccagaactgcccggcagttgccggaaggaattcaaagagaacaaagaaccttctccaaaggctaagcgcaagcgaagtgtgaagattagcaacgtggctttggattctatgcattggcaaaatgactctgtccagatcatagcaagtgtcagtgatttaaaaagcatggatgaatttcttctgaaaaaggtgaatgacctagataatgaagacagcaagaaggatacactagtggatgttgtatttaaaaaagccctgaaggaatttcggcagaatatcttcagcttttattcatctgcattggcgatggatgatgggaaaagcatacggtataaagacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgccaaaaacagaaagaaagaaaagaaggaaaaaggaaactgatttggtggaagaacacaatggtcacatctttaaagccacccaatatagcatccctacatactgtgaatactgttcttctttgatatggataatggaccgagcctctgtttgcaaattatgcaagtatgcttgccataagaagtgctgtctgaaaaccacagccaagtgctctaaaaagtatgatccagagctgtcatctcgacaatttggggttgaactgtcccgtttgaccagtgaagaccgaactgttcctttagtagtggaaaagctcataaactacattgaaatgcatggactgtatacagaaggtatttatcgaaagtctggttcgactaataaaatcaaggagcttcggcagggtctagatacagatgctgagagtgtaaatctagatgactataacatacacgtcattgcaagtgtattcaaacaatggcttcgagatttgcccaatcctctcatgacctttgaactctatgaggaatttcttcgagctatgggccttcaggagaggaaggagacaatccgtggtgtatactctgtgattgatcaactctcccgaactcatctcaatacactggaacgcctcatctttcatctagtcaggattgctctgcaggaagacactaatcgaatgtctgctaatgctttggccattgtgtttgcgccctgcattctccgctgccctgacaccactgacccactacaaagtgtacaggacatcagtaagactaccacttgtgtggaactgattgttgtggaacaaatgaataaatacaaggctcgtctcaaagatatcagtagcttggaatttgctgagaataaggcaaagaccaggttgtcactgattcgtagatcaatgggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaaggaggagctaacatttgagatgcttgtactggaaccccgtgcctctgatgatgaaacccttgagtctgaggcctccattgggactgctgatagctcagagaatttgaatatggagtctgaatatgctatctctgagaaatcagaaagaagcttagcccttagctccctgaagacagctggcaagtctgaaccttccagcaagttgcgaaagcaacttaaaaagcagcaagactctttagatgtcgtggactcttcggtctcctctttatgtctgtctaacacggcatcatctcatgggaccagaaaactatttcagatttattccaaatctccattctaccgagctgcctcaggtaatgaggccctgggaatggaaggaccattgggccagaccaaattcctggaagacaagcctcagttcatcagcagaggaaccttcaacccggaaaagggcaaacaaaaattaaagaatgtgaaaaactcacctcagaaaaccaaagagaccccagaggggacagtcatgtctggccgcagaaaaactgtggacccagactgcacctccaaccaacagctagcactctttggaaataatgaatttatggtctgaaccggcagatgtgtgtccctccgtggctacagagtggtaaacaaatctcacctttggggctgcgtttcatcacctcgtccacaatagtcaatcctaattgtggtcctgcctcttttctaagcatatggctaagactgtatgtgctgaattcctgggcctcctgcagaagcagaaagcctgctggggatggtgccagctgtgccttggctgttgtatttgaattgagatttttactatacaaagccacctagggcctggggatttgggtcagttgtagttgcctctcccccaccctcttttcccttcccaaaggtgggtgttgaactaggggggatattgctgtcctgagggaccctctcatttctgacatttgaagaaaacgtataaatctttcttaaccgtgaaagcaaaagcctttgggtttattttgggatagttaggagctagggtagaatataatttttttccaaaaacttacttacaaacaaaaagcctaatccctctattttaagatttctgaaaaaacactccatgttatattctggggaaagcaaaaacaaaaaaaaaaa

SEQ ID NO: 344529 - DNA, 8500 bp, Homo sapiens
  misc_feature (4013)..(4013): n is a, c, g, or t
gcggccgctcgcccggaccctgaggctgctgggcccaccctcccggaaccgtccgaccctcggtggcctcggcctcttctgccatctccggtcctaccctggggcggagggtggaaggcagcttccgtcgaagaggagggggctgcggtggccaccgcggcggagcccgagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcagataacaaagaaacccctcagacagagctgggatgattattgctatgactctgagccggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggacatgatgatacagcgccatgtgcaattttgaaaagtatggatagttttagctttctccaacacccagtccaccagaggagcttagagattctgcagagatgcaaggaagagaagtacagtataacccggaaaaatcccagaacacctctttctgatctccagggcatgaatgctctaaatgaaaaaaaccaacatgatacatttgatattgcctggaatggcagaactgggattcgccagagcagactatcaagtggcacctccttgcttgataaagatggaatatttgctaattcaactagcagcaaactcctggagagagcccatggaattctcacgagaaacaaaaatttcaaatccaagcctgcccttccaaagcacttgctagaagtaaattctttaaagcacctgacaagactgacactacaagatcgcattaccaagtctcttcttcatttacacaagaagaaaaaacctcccagcatcagtgcccagtttcaggcatcattaagcaagctaatggaaacacttggtcaagcagaaccatattttgtaaaatgcattcgctctaatgctgaaaagctgcccttaaggttcagtgatgtcttggtacttagacagcttcgatacaccgggatgctggaaacagttcaaattcgccaatcaggatacagctccaaatattctttccaggattttgtgagccacttccatgtacttcttccccgaaatattattccatccaaatttaacattcaggatttcttcaggaaaataaatcttaatccagataattatcaagttggaaaaaccatggtctttctaaaggagcaggaacgacagcacttacaagatctgcttcaccaagaggtgctccgcagaatcatattgttgcagcgatggttcagggtcttgctgtgtaggcagcatttcctccatctgagacaagcatctgttattatccagagattctggaggaattacctaaatcagaagcaagtcagagatgcagctgtgcagaaggatgcttttgttatggctagtgcagctgctcttctccaagcttcctggcgtgctcacttagagaggcagcggtacttggagttacgggctgcagccatcgttatccagcagaaatggagagattactataggcgcaggcacatggctgctatttgcatacaagcaagatggaaagcctacagggaaagtaaaaggtaccaagaacaaaggaaaaaaattatccttttgcaatcaacatgtagaggattcagagcaagacaaagatttaaagctttaaaagaacaaaggctaagagaaacaaagccagaagttggattggtgaatattaagggatatggatctctggaaattcagggttcagacccttcagaatgggaggattgttcttttgacaacagaataaaagccatagaggaatgtaaatctgtaatagagagtaatcgaattagccgtgaaagttcagtggactgcttgaaggagtcaccaaacaagcagcaggagagagcccaaagccagagtggtgtggacttgcaggaagatgtgcttgtaagagagagacccagntccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggacaatatgagtattccccttgtcagcaaagaagccttaaacagtaaaaatcctcaactccataaagaagatgaaccagcatggaaacctgtgaagttagctgggccaggccaaagagagcaggttgccagaccggcccataaaaagaaagctcgaatggcgcggacgcgctccgatttcttgactagaggtacttttgccgatggggagggggatacagaggaagatgattacgatgacattattgagccccttctctcccttgaccaagcttctcactgtgagctagggcctgcacccagcctgggtcaggcctctcacagtgactccgaaatgacatcacagcgattttcgtcagttgatgaacaagcaaaacttcataagactatgtctcaaggagagattaccaagttggcagtgagacagaaggcttcagattcagatataagacctcagagagctaagatgagattctgggccaaagggaaacaaggggagaagaagactaccagagtgaaacctactacccagtcagaggtttcgccactctttgcaggcacagatgtgattccagctcatcagtttccagatgaattagctgcatatcacccaacacctcctttgagcccagaactgcccggcagttgccggaaggaattcaaagagaacaaagaaccttctccaaaggctaagcgcaagcgaagtgtgaagattagcaacgtggctttggattctatgcattggcaaaatgactctgtccagatcatagcaagtgtcagtgatttaaaaagcatggatgaatttcttctgaaaaaggtgaatgacctagataatgaagacagcaagaaggatacactagtggatgttgtatttaaaaaagccctgaaggaatttcggcagaatatcttcagcttttattcatctgcattggcgatggatgatgggaaaagcatacggtataaagacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgccaaaaacagaaagaaagaaaagaaggaaaaaggaaactgatttgtatgatccagagctgtcatctcgacaatttggggttgaactgtcccgtttgaccagtgaagaccgaactgttcctttagtagtggaaaagctcataaactacattgaaatgcatggactgtatacagaaggtatttatcgaaagtctggttcgactaataaaatcaaggagcttcggcagggtctagatacagatgctgagagtgtaaatctagatgactataacatacacgtcattgcaagtgtattcaaacaatggcttcgagatttgcccaatcctctcatgacctttgaactctatgaggaatttcttcgagctatgggccttcaggagaggaaggagacaatccgtggtgtatactctgtgattgatcaactctcccgaactcatctcaatacactggaacgcctcatctttcatctagtcaggattgctctgcaggaagacactaatcgaatgtctgctaatgctttggccattgtgtttgcgccctgcattctccgctgccctgacaccactgacccactacaaagtgtacaggacatcagtaagactaccacttgtgtggaactgattgttgtggaacaaatgaataaatacaaggctcgtctcaaagatatcagtagcttggaatttgctgagaataaggcaaagaccaggttgtcactgattcgtagatcaatgggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaaggaggagctaacatttgagatgcttgtactggaaccccgtgcctctgatgatgaaacccttgagtctgaggcctccattgggactgctgatagctcagagaatttgaatatggagtctgaatatgctatctctgagaaatcagaaagaagcttagcccttagctccctgaagacagctggcaagtctgaaccttccagcaagttgcgaaagcaacttaaaaagcagcaagactctttagatgtcgtggactcttcggtctcctctttatgtctgtctaacacggcatcatctcatgggaccagaaaactatttcagatttattccaaatctccattctaccgagctgcctcaggtaatgaggccctgggaatggaaggaccattgggccagaccaaattcctggaagacaagcctcagttcatcagcagaggaaccttcaacccggaaaagggcaaacaaaaattaaagaatgtgaaaaactcacctcagaaaaccaaagagaccccagaggggacagtcatgtctggccgcagaaaaactgtggacccagactgcacctccaaccaacagctagcactctttggaaataatgaatttatggtctgaaccggcagatgtgtgtccctccgtggctacagagtggtaaacaaatctcacctttggggctgcgtttcatcacctcgtccacaatagtcaatcctaattgtggtcctgcctcttttctaagcatatggctaagactgtatgtgctgaattcctgggcctcctgcagaagcagaaagcctgctggggatggtgccagctgtgccttggctgttgtatttgaattgagatttttactatacaaagccacctagggcctggggatttgggtcagttgtagttgcctctcccccaccctcttttcccttcccaaaggtgggtgttgaactaggggggatattgctgtcctgagggaccctctcatttctgacatttgaagaaaacgtataaatctttcttaaccgtgaaagcaaaagcctttgggtttattttgggatagttaggagctagggtagaatataatttttttccaaaaacttacttacaaacaaaaagcctaatccctctattttaagatttctgaaaaaacactccatgttatattctggggaaagcaaaaacaaaaaaaaaaa

SEQ ID NO: 344530 - DNA, 1668 bp, Homo sapiens
tttggaatggatgcagcttatattaaaagaagaaactcatctcagtacacaatgggttcttacactcccacctaccaaagtatccgttttccagtactcctgcaagaaatattttaacttaaatgtgttgtatgaatatgtctcactaaatatcctaggcctcgcaggtgtttccatttattcttatcattcacctggtgtgatggaaatacacttgttatcctaaaagagcaatgtaaaactgatgcagtcactcaatttactttctaacatgaatttttctctgcagggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaaggaggagctaacatttgagatgcttgtactggaaccccgtgcctctgatgatgaaacccttgagtctgaggcctccattgggactgctgatagctcagagaatttgaatatggagtctgaatatgctatctctgagaaatcagaaagaagcttagcccttagctccctgaagacagctggcaagtctgaaccttccagcaagttgcgaaagcaacttaaaaagcagcaagactctttagatgtcgtggactcttcggtctcctctttatgtctgtctaacacggcatcatctcatgggaccagaaaactatttcagatttattccaaatctccattctaccgagctgcctcaggtaatgaggccctgggaatggaaggaccattgggccagaccaaattcctggaagacaagcctcagttcatcagcagaggaaccttcaacccggaaaagggcaaacaaaaattaaagaatgtgaaaaactcacctcagaaaaccaaagagaccccagaggggacagtcatgtctggccgcagaaaaactgtggacccagactgcacctccaaccaacagctagcactctttggaaataatgaatttatggtctgaaccggcagatgtgtgtccctccgtggctacagagtggtaaacaaatctcacctttggggctgcgtttcatcacctcgtccacaatagtcaatcctaattgtggtcctgcctcttttctaagcatatggctaagactgtatgtgctgaattcctgggcctcctgcagaagcagaaagcctgctggggatggtgccagctgtgccttggctgttgtatttgaattgagatttttactatacaaagccacctagggcctggggatttgggtcagttgtagttgcctctcccccaccctcttttcccttcccaaaggtgggtgttgaactaggggggatattgctgtcctgagggaccctctcatttctgacatttgaagaaaacgtataaatctttcttaaccgtgaaagcaaaagcctttgggtttattttgggatagttaggagctagggtagaatataatttttttccaaaaacttacttacaaacaaaaagcctaatccctctattttaagatttctgaaaaaacactccatgttatattctggggaaagcaaaaacaaaaaaaaaaa

SEQ ID NO: 344531 - DNA, 2676 bp, Homo sapiens
gcggccgctcgcccggaccctgaggctgctgggcccaccctcccggaaccgtccgaccctcggtggcctcggcctcttctgccatctccggtcctaccctggggcggagggtggaaggcagcttccgtcgaagaggagggggctgcggtggccaccgcggcggagcccgagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcagataacaaagaaacccctcagacagagctgggatgattattgctatgactctgagccggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggacatgatgatacagcgccatgtgcaattttgaaaagtatggatagttttagctttctccaacacccagtccaccagaggagcttagagattctgcagagatgcaaggaagagaagtacagtaaggctacaaatcctgataaactgttatcacatatccatttggaaatggaaaccaggagcatcctacaccagggtgggatatagattgtatgggcaacatggcctccataaacctctgagcagtctttga

SEQ ID NO: 344532 - DNA, 401 bp, Homo sapiens
ccgagcctctgtttgcaaatgtaagtatgagagatctttgaggaatatttttaaccactgacatttctgtttccttgagttgtcttatatctcctttaacataaaggagttatttacactacctaaatttttaacctcatctcttgctatactctcttcacctactctttgtctctaaaccagatattttgatgttatttggtcactgagagtcttgtacatgtaattcactctgtctaaaatggtcttgtcccagattttagtatgacttaatatttcaattacttcatgcctacactcacatctcaccttctcagagagctctcttttctacccccagtttaaatgccaccttgtccccaaattcgctattcttttttttgtttttgagatggtgtctt

SEQ ID NO: 344533 - DNA, 356 bp, Homo sapiens
tttggaatggatgcagcttatattaaaagaagaaactcatctcagtacacaatgggttcttacactcccacctaccaaagtatccgttttccagtactcctgcaagaaatattttaacttaaatgtgttgtatgaatatgtctcactaaatatcctaggcctcgcaggtgtttccatttattcttatcattcacctggtgtgatggaaatacacttgttatcctaaaagagcaatgtaaaactgatgcagtcactcaatttactttctaacatgaatttttctctgcagggaaaggggcgtattcgtcgaggaaactatccaggtccatcgtctcctgttgtagttcggttgcctt

SEQ ID NO: 344534 - DNA, 350 bp, Homo sapiens
ccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaagtgagtatccaggaggaaggggagagacagttatagtctgtttttgtttccttccttctatcgtttctttattttttcttatttattatctcctgtgtgttaaacactgtgtcagatgatacaggagatgttgagatgacaaagacgtgttgtctatactcaggtaacagtgtgagagttgtt

SEQ ID NO: 344535 - DNA, 309 bp, Homo sapiens
aagatggaaagcctacagggaaagtaaaaggtaccaagaacaaaggaaaaaaattatccttttgcaatcaacatgtagaggattcagagcaagacaaaggtaatctctattactataataattgctttttttcttcttcccaagtactttgtttatacctctgcattaacacttgtctaatttgtattagaattggttgtatacaatttgtcttttccactatactgtgataccgattttaacccacattgtattgtctataatggaagttaaataaggttttattgaattaaattggattgaaaatct

SEQ ID NO: 344536 - DNA, 470 bp, Homo sapiens
attgagatttagctctttttattgagtaaacactctctgggttgttgcaagctttcgattagtttccacagttctgaaaaggttaattatgacagatttgccagatttctcattggttttatggagaagagaattttcagaggtcctaactttgttaactttgctgccttcatccctctcttttgtattccacatccaaaacatcattcaatttttaggagtacttaaacgctgaatttatcacatttatattaaaaaatgaagcaaagctgatacattttactaattactgtttgcttcccccctccccctgttaaatgataaccataagtcacacattatgaaacttgtacttctttgtttcccacaggaactatcatgtattctattacctcctggcaggagcaagtgaagatgagagatcagcattccatcttaagcaaccagaggaatatcattatctcaatcag

SEQ ID NO: 344537 - DNA, 453 bp, Homo sapiens
atgatatgttttgaatactggccaaacacaatcccctgtacactgctttagaggaattgagcattttgttacttatgttgtggatattattcattaaataaatttaaacattacttttaatcaaaactttctcttgttttacagacattgtctattggtgttcttgatatttttgggtttgaagattatgaaaataacagctttgaacagttctgtattaattttgctaatgaacgtttacagcactactttaatcagcatatctttaaattggaacaagtgagtacctaaatatgtatacacttgtccccccatcacacatatctttgagtcatattcataataattcacttcattttttcacacattttattgatttacatagtgtttttattaaatattgaaacgtgcctttacaaacaagaataaccgaagtaaattggcttgggaaca

SEQ ID NO: 344538 - DNA, 378 bp, Homo sapiens
aatcttgatttttaaacttttattttaaataagcaggattgcttcacggtggaaggagaagatttgagacatgactttgagcgcctacaacttgccatggaaatggtaggatttcttcccaagacacgaagacagtgagtttacttgttgtatttttatatctctaatagagaacacatgatatgtctttgaaagatttctgccgttgacctttttaaatagttttctaagtggtattcttcatctagtacctcatccatctcgagcattatttctaattcctttttttatcataaattattttgagaatctgatgaaagctgacactgttgttgtaaaatgtacatccttaacaatttgcatataaatgcaggaatt

SEQ ID NO: 344539 - DNA, 7429 bp, Homo sapiens
  misc_feature (4013)..(4013): n is a, c, g, or t
gcggccgctcgcccggaccctgaggctgctgggcccaccctcccggaaccgtccgaccctcggtggcctcggcctcttctgccatctccggtcctaccctggggcggagggtggaaggcagcttccgtcgaagaggagggggctgcggtggccaccgcggcggagcccgagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcagataacaaagaaacccctcagacagagctgggatgattattgctatgactctgagccggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggacatgatgatacagcgccatgtgcaattttgaaaagtatggatagttttagctttctccaacacccagtccaccagaggagcttagagattctgcagagatgcaaggaagagaagtacagtataacccggaaaaatcccagaacacctctttctgatctccagggcatgaatgctctaaatgaaaaaaaccaacatgatacatttgatattgcctggaatggcagaactgggattcgccagagcagactatcaagtggcacctccttgcttgataaagatggaatatttgctaattcaactagcagcaaactcctggagagagcccatggaattctcacgagaaacaaaaatttcaaatccaagcctgcccttccaaagcacttgctagaagtaaattctttaaagcacctgacaagactgacactacaagatcgcattaccaagtctcttcttcatttacacaagaagaaaaaacctcccagcatcagtgcccagtttcaggcatcattaagcaagctaatggaaacacttggtcaagcagaaccatattttgtaaaatgcattcgctctaatgctgaaaagctgcccttaaggttcagtgatgtcttggtacttagacagcttcgatacaccgggatgctggaaacagttcaaattcgccaatcaggatacagctccaaatattctttccaggattttgtgagccacttccatgtacttcttccccgaaatattattccatccaaatttaacattcaggatttcttcaggaaaataaatcttaatccagataattatcaagttggaaaaaccatggtctttctaaaggagcaggaacgacagcacttacaagatctgcttcaccaagaggtgctccgcagaatcatattgttgcagcgatggttcagggtcttgctgtgtaggcagcatttcctccatctgagacaagcatctgttattatccagagattctggaggaattacctaaatcagaagcaagtcagagatgcagctgtgcagaaggatgcttttgttatggctagtgcagctgctcttctccaagcttcctggcgtgctcacttagagaggcagcggtacttggagttacgggctgcagccatcgttatccagcagaaatggagagattactataggcgcaggcacatggctgctatttgcatacaagcaagatggaaagcctacagggaaagtaaaaggtaccaagaacaaaggaaaaaaattatccttttgcaatcaacatgtagaggattcagagcaagacaaagatttaaagctttaaaagaacaaaggctaagagaaacaaagccagaagttggattggtgaatattaagggatatggatctctggaaattcagggttcagacccttcagaatgggaggattgttcttttgacaacagaataaaagccatagaggaatgtaaatctgtaatagagagtaatcgaattagccgtgaaagttcagtggactgcttgaaggagtcaccaaacaagcagcaggagagagcccaaagccagagtggtgtggacttgcaggaagatgtgcttgtaagagagagacccagntccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggacaatatgagtattccccttgtcagcaaagaagccttaaacagtaaaaatcctcaactccataaagaagatgaaccagcatggaaacctgtgaagttagctgggccaggccaaagagagcaggttgccagaccggcccataaaaagaaagctcgaatggcgcggacgcgctccgatttcttgactagaggtacttttgccgatggggagggggatacagaggaagatgattacgatgacattattgagccccttctctcccttgaccaagcttctcactgtgagctagggcctgcacccagcctgggtcaggcctctcacagtgactccgaaatgacatcacagcgattttcgtcagttgatgaacaagcaaaacttcataagactatgtctcaaggagagattaccaagttggcagtgagacagaaggcttcagattcagatataagacctcagagagctaagatgagattctgggccaaagggaaacaaggggagaagaagactaccagagtgaaacctactacccagtcagaggtttcgccactctttgcaggcacagatgtgattccagctcatcagtttccagatgaattagctgcatatcacccaacacctcctttgagcccagaactgcccggcagttgccggaaggaattcaaagagaacaaagaaccttctccaaaggctaagcgcaagcgaagtgtgaagattagcaacgtggctttggattctatgcattggcaaaatgactctgtccagatcatagcaagtgtcagtgatttaaaaagcatggatgaatttcttctgaaaaaggtgaatgacctagataatgaagacagcaagaaggatacactagtggatgttgtatttaaaaaagccctgaaggaatttcggcagaatatcttcagcttttattcatctgcattggcgatggatgatgggaaaagcatacggtataaagacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgccaaaaacagaaagaaagaaaagaaggaaaaaggaaactgatttggtggaagaacacaatggtcacatctttaaagccacccaatatagcatccctacatactgtgaatactgttcttctttgatatggataatggaccgagcctctgtttgcaaattatgcaagtatgcttgccataagaagtgctgtctgaaaaccacagccaagtgctctaaaaagtatgatccagagctgtcatctcgacaatttggggttgaactgtcccgtttgaccagtgaagaccgaactgttcctttagtagtggaaaagctcataaactacattgaaatgcatggactgtatacagaaggtatttatcgaaagtctggttcgactaataaaatcaaggagcttcggcagggtctagatacagatgctgagagtgtaaatctagatgactataacatacacgtcattgcaagtgtattcaaacaatggcttcgagatttgcccaatcctctcatgacctttgaactctatgaggaatttcttcgagctatgggccttcaggagaggaaggagacaatccgtggtgtatactctgtgattgatcaactctcccgaactcatctcaatacactggaacgcctcatctttcatctagtcaggattgctctgcaggaagacactaatcgaatgtctgctaatgctttggccattgtgtttgcgccctgcattctccgctgccctgacaccactgacccactacaaagtgtacaggacatcagtaagactaccacttgtgtggaactgattgttgtggaacaaatgaataaatacaaggctcgtctcaaagatatcagtagcttggaatttgctgagaataaggcaaagaccaggttgtcactgattcgtagatcaatggtaagatgcaacacatggaatagtggaaaaatgggagttgtcttgggaatttaaatgtgcttttgtggtgtatacaaggattattatcagaatcttttttataaaaaacaagtaaaacgtcaccaaatctcaag

SEQ ID NO: 344540 - DNA, 2238 bp, Homo sapiens
gcggccgctcgcccggaccctgaggctgctgggcccaccctcccggaaccgtccgaccctcggtggcctcggcctcttctgccatctccggtcctaccctggggcggagggtggaaggcagcttccgtcgaagaggagggggctgcggtggccaccgcggcggagcccgagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcaggtgagagttcataaaaagcattttgaagtatagggcagtattaaatttaatgcttgaaaaatgtcttttttctagtactttctcaaacctaggaatggattagctagcattttcatatatgtactctacaaatttaggtgatgcagttctcaaatttgaggatgattaccatcctcatataaatgttaaaagctcagataatatatgtgcttttcgttttctgtgagattctttgggaaaataataataagctgtttattgatatttctactgtattagaaaaatgctttacttttactaaagtgatttaccttttacaacccccaggatattaaatgttactaatgattaattcttgtcctttgcaagggattacttgaaacctaatttgcatgttttgaagtctcatacacatacgtctttgcatgatactatgacactgacttagagtatgactatttttataatttaatgaacaatcttcttaaatattcagtatgaaggtcatcaaaggcaaatgacttagagaatttggatctttcctcaaaactcaaaattcatccctaaacttccacattgaggagtaattcttacttttcattacattgactttactaattttattatttctcataataacagaaattttacaaccagcactaatggaattagtaaaacaataggtcatttaaataatagatgtctccccttatttttccattgttggaggcaagatgtaatgtctacggaaataaatccctttatgaccattaaaaaaatccttacgaagcttttgtaaacaaattgacactttgatgatggttcagatagcagtatatatttagggttatgaaagttacatctttggctgagtgcagtggctcacacctgtaatccc

SEQ ID NO: 344541 - DNA, 1156 bp, Homo sapiens
  misc_feature (737)..(737): n is a, c, g, or t
  misc_feature (1144)..(1144): n is a, c, g, or t
  misc_feature (1146)..(1149): n is a, c, g, or t
tctgctcctaacgccattgaatttggcaaatgtagtaaaattggttgtaatttgataactagtttcagtttcactgagatatgaaggagaccagtggcttccaactatggtgtcaacacagtgttgtgttaaactcagctgtgaggtattaacagctactgataacctaaagaagtttgcagatgacttattttaagatatctacgtataaacgagagtggatttacgttcaaccctaaaatgctactttcacttgcattctgacatgaagggatggagctgcaactgtcatggtgggcattttgtataaattgcagttgcttgatcttactgataagtctttaatcacagtggaaattacatatgtgtgtatttccctgaacatttttttttatagtggttcattagaatctggatttgtttatcctagtgtttcgtagaagtgaatgttatatcatgtatatctctggggggaagaaaggccgagacctgtcatgggagactgtgcctttgctagccagtctgtaaattgaataatcttgaaacatttaggtaggcacatttggggtgacttcaaagtgctttatgaagtcttctctcctcacacatctccagagactaccatacctgaaatttcatgattgtttaagataagaattgctttttatgatagatatttcagaagtaactgatatttaaaacataattaactgactaatttaaatttttttcctttngggtaatgttgaatctaggaaaaaaatcctgttattcaggagcctttttgagagttaactttcatgcttctttttaaatccatatcccatgcctctttgaaattgtcactcgggggttgggcgcggtggctcacacttgtaattccagcactttgggaggccgggtgggtggatctcctgcggtcaggagttttagaccagcctggccaacatggcaaaaaatcatttccactaaaaatataaaaattagctgtgcgtggtgtcatgcgcctgtaatcccagctacttgggaggctgaggcaagagaatcgcttgaacctgggaggtggaggttgcagtgagcagagatcacgacattgcactcaagcctgggcgacaagagtgaaactctgcctcaaaaaaaaaanannnntcacttg

SEQ ID NO: 344542 - DNA, 359 bp, Homo sapiens
tactcaaaattctttcctgaatgacaacgtgaagttaaaatactttgttcttaacagttaacttcattgacatgacgcttctgcttcttgactaaggaaacttggctaataagagctttttgtttattcaagtaaaagtggactgcaagttgtaggattttatagcctccctgcatctttgcttaattaaggcatgcatagagaatgttttgctagcatattacttgatttaaaatatctaaatatggctgatatttaaatagttaccatcctcttgacttggcttcccctattttattggcttctgaatgattgtttttcttatcgttaggctaggaaaaattattgcaagctttaat

SEQ ID NO: 344543 - DNA, 744 bp, Homo sapiens
agggagctgtgccatgctgaatctgcagcatgccttggacataagcatgtagcttgtcttctccagcttggaggagagtctcagaggaaaggtcttagaggaatgcaaaggtggaggggtcctcataatatggaacaacgacagctctgtatcacccttcttatggaaaaacccagaataactgcccatgtgttctgtgaccttggattgtggaggaacagacggatgtcgattctgccagccactccttccccagtgggcagcacatccttgccccccaaccttcctgggcacctggagttcagatactaggggaatattaatcagggtccaaccaggaaaacagaaacccttctctgcagttaacagagagggaagtaaatgcaggacggtgcccctgcattggatcccagcacaggcaaagaacgttagtggaaagatgatgaaatccaaagaaagcctgtcagttaattattgtaccagtgttaatttttttttttttttggcggatgtgctggggtcgtgtaaagcatgaacattagagggacctggatgaagggcatatgggaactctctgtacctctgcaactcttttgcaagtttaaatttattcccaggtaagaagtgtgtttaaaaaatgaattagtcggccgggtgcagtggctcacgcctgtaatctcagcactttgggatgccaaggtgggcggatcacctgaggtcgggagttcgagaccagcttgacca

SEQ ID NO: 344544 - DNA, 408 bp, Homo sapiens
tgggaggacctcctgagccccgaggtcgaggctgcaatgagccgagattgtaccacagcactccagcctgggcagggacagagtgagaccctgtatccaaaaaaaagaaagaaaaaagaaaagaagtgatttctaaattttcttgcttgcaccattaagctgatatttagtggtggtaaagtattgatttgaatttgaaaaatattaataaggaaaagtgtttgacttgttcaatgtatatgaaacacttctgtgtcattttacattttacaacagttttattccttctgtgtgtacatacaggtttatctatttagacctgcctctctacaaaatagatttgaggcagctgacattaagagtacaaaccaggaaacaatatttaggtataaaaagataaagtacggc

SEQ ID NO: 344545 - DNA, 544 bp, Homo sapiens
cagtcatcaaagtcagagaaattaacatcagtacattgctgccatctaatgcttactccctactcaagtttcactagtttgctccaaaagtgtcttttatggcaggaggatcagaattaatgtataggccaggcacagtgccttgaatctgtaatcccagcactttgggagaccaagtaggagggttgcttgaacccaggagttcgagaccagcctgggaaacatagcaagactctatctacaaaaaaatagaaaaattaaccaggcatggtggcacacacctatagtctcagctacttgggaggctgaggcaggaggatcactcgagcccaggaggtcgaagtcatagggagccaaggttgcacctctgcattccagtttgggcaatagggtaagactctgtctcttaaaaaaagaaaagaaaaagaaaaagaatgaacgtgtagcagtttgttgtcatgtcttttaatcacctctagtctttaacagttatcagtctttactttcgtgatcatgagcttttgaagatcacaggccacctatt

SEQ ID NO: 344546 - DNA, 703 bp, Homo sapiens
cattgtcagtcaatgtttactcttagtgatgctcgtatgggaaatgtattatttgtattaccccaagttccaatcataaaacaactcatcgatctttaaaataaaaatgggcactgagttgcagtccaggcatattcagtaagtgacctgatcagtcaatatcagtaaggaggtagacaataagacctttgtatcagtcaggggaggttaacaggtagtaacaaataacccctgaatctcatgggcttaagacaaagttttcttcctcactcatactacatggctgactctggcaaatgggggcattgcttctcagggggctcagcccctggaacgttgctggccaccatgggaggagaaggagagtatactcacacccacacatatacgaaatgctcggcagaagcggcaggtctcttccactcacagctcattggccagaaccaaccacattgctccattgaacacaggggtccaaatgacatcctcctaccatttctccacatcatagagagccagaagtacctgacgaggagcatgactaaatattgctggctacaactgagtcagcaagacctacgcctgcacaatattctggagtgttcaatgggcttcaggaatgagttgcattcagtgatggaaaatagcaattgctattgatgaagctcccaattattgttgaataacttgaaagagttttaac

SEQ ID NO: 344547 - DNA, 787 bp, Homo sapiens
actacagtacagctcctaaaaagaaatgtattcagataaaagatttgatattactaggaagaattaacccaggaaataacattctggaattcaaaacacaggagactacccacaaagccagtattttattgaatggtaaacttaaggtagaaagtggtcagatttataaaaacccagtcacctggctcaaggatcttctgggaggcaacagttatgtgacctggaattatgcttggagtaaggtaacgtatcttgggaaggagcttttaaggtatgtttctgaggatgcacccatacttccagaaccaaactcagtacctcagcaatatcaaccttgtcttccagaagttgcttgtttagatgacccagtacaggaacccaaacaaatcaatgtttgagaaaacaaaatttggaccaaggaacttccagagagtcaatgtaaagcagcccacgttatctacaaataaatgaaatactattaatcagtgatcaagaatttctcccatgccacataatggatcagcattggaagttttgtgtggaatgtgaggaactaacaccctaaaaccttggtttcttaatattttattggatatttgttcaaattatcaacaaacatttatatttcatcttgtataatctggtgggcctattttaacatacactttatgagttgctatttaggatgtatgtttactgttcttaagatgtatgtaactgttcaacaattatataagattaatgcttttttgccattgaaataaaggcacatttgaactagaccata

SEQ ID NO: 344548 - DNA, 1308 bp, Homo sapiens
actacagtacagctcctaaaaagaaatgtattcagataaaagatttgatattactaggaagaattaacccaggaaataacattctggaattcaaaacacaggagactacccacaaagccagtattttattgaatggtaaacttaaggtagaaagtggtcagatttataaaaacccagtcacctggctcaaggatcttctgggaggcaacagttatgtgacctggaattatgcttggagtaaggtaacgtatcttgggaaggagcttttaaggtatgtttctgaggatgcacccatacttccagaaccaaactcagtacctcagcaatatcaaccttgtcttccagaagttgcttgtttagatgacccagtacaggaacccaaacaaatcaatgtttgagaaaacaaaatttggaccaaggaacttccagagagtcaatgtaaagcagcccacgttatctacaaataaatgaaatactattaatcagtgatcaagaatttctcccatgccacataatggatcagcattggaagttttgtgtggaatgtgaggaactaacaccctaaaaccttggtttcttaatattttattggatattggtcaacaaaccgctcacacttcatatctaaccatttctactctctctgtccctcttttcacccaacactctattaaccacatattatgcaacctgtctaccctcccgcacacactgatccgtacacaacacttcgctgccgtgctctgttattttaccccttattgactcttccatttctcctcctccccgtatccacctcagctcccttcttgccctcctttacttaactccctcataaaccactcgcatatacacattttgatactcccatgtcccacgactgcatccgcacaattctcagtcgctaaattattaccctcaatcgctccgtatcctttacttaatactccactatccacccaactcgtactctccctcacatcgtccaatcctcaatcatattattccctccccctctatctacagttcgtgcctgtttcgtcttccctcctttcttctcttcttcccctcttcacttacttcattattttctacctccattcccatttcctcgctgcacacatactaagtcctctaatatttctcatttgcccaatttattaattagcaccgccattcataataaccctgcacagccccgctcattaaaccccccacacatttattgctttcccatcccatagtccgatatgatgacctagctatttcattaacccaatatactctttccctaatcgctgcatattt

SEQ ID NO: 344549 - DNA, 1220 bp, Homo sapiens
actacagtacagctcctaaaaagaaatgtattcagataaaagatttgatattactaggaagaattaacccaggaaataacattctggaattcaaaacacaggagactacccacaaagccagtattttattgaatggtaaacttaaggtagaaagtggtcagatttataaaaacccagtcacctggctcaaggatcttctgggaggcaacagttatgtgacctggaattatgcttggagtaaggtaacgtatcttgggaaggagcttttaaggtatgtttctgaggatgcacccatacttccagaaccaaactcagtacctcagcaatatcaaccttgtcttccagaagttgcttgtttagatgacccagtacaggaacccaaacaaatcaatgtttgagaaaacaaaatttggaccaaggaacttccagagagtcaatgtaaagcagcccacgttatctacaaataaatgaaatactattaatcagtgatcaagaatttctcccatgccacataatggatcagcattggaagttttgtgtggaatgtgaggaactaacaccctaaaaccttggtttcttaatattttattggatatttgttcaaattatcaacaaacatttatatttcatcttgtataatctggtgggcctattttaacatacactttatgagttgctatttaggatgtatgtttactgttcttaagatgtatgtaactgttcaacaattatataagattaatgcttttttgccattgaaataaaggcacatttgaactagaccataaagaaaaaaaccacgacacttctaccacatcgctccttcatacacacccctacgcccccaaaaatccctttcacgtccgtaccttagcaatactctcctccctccccctctcccttccccacctttcccccgccctctttgaccccaacccgcaccgtccacccccctcacttgcgacatagcttcacctaatcctcccgcttacccgtcactttccctttccacatcctccatcccgcacttctctctcacactctttcattctcgcatttccttccctctacccacatatccaccctctctctaaaccataacctactccgtcacacccccccgtacactacctattaacgcttcccgcgccccatccgctcactaccaacatccccaccttttgcgcacataaccacccccccactcccctcatccttct

SEQ ID NO: 344550 - DNA, 1121 bp, Homo sapiens
tggctcatgcctgtaatcctagcactttgggaggccgaggtgggcagatcacctgaggtcaggagtttgagaccagcctggcaacatggcgaaaccccatctctactaaaaatacgaaaattagccacgcatggtggcaaacacctgtaatctcagctactcgggaggctgagataggagaattgtttgaacctgggaggcggaggttgcaatgagccgagatcgtgtcactgcactccagcctgggcaacagagtaagactccctctcaagaaaaaaaaagaaaaaatcaaatggccaggtgtcaggtatataagtctaaatgacagtaacagcagaaagtggtgttgatagaggtttgaagaattctgggtagttgtgcagtgttggtgggggtgtcaggtgttctgattatgtaaatgtcagatacataccttttgaccttaagttttacttctggaactttatcccagggaagtaattggataacagtgtacagttaaaagttagaatgctaattatgtttttgatactgcaaaagctgaaaacaacctaaatttcactaatagacatttgaccaaatagctttttccacaaagtgaaataccagatagcctttgaaaagaatggtcggtcatctccctgggtatggaaaagtgcctacagtgtattgtttagtgaaaagaaagcaggaagtagactagccagcaaaagattatcctatctttagggaaacatgttagctctaaaatgtggacccaaaaaagatatcagggaagctgttaactgccgcattgggaatggacatttgggaatctttaatattctgtactacatttctgatagctttttaaacacgatcaaaatattttatttgaggcaatagagcttgaacaaagacagacatgtagacagattaagttatctgtgtaaagaggctcacatagcacctgatacctaccaagggctgacagcaaaggtcacccatgttgtgatacactgacttgtgtctgtattgggagacagtagtcaagagaagctgatgggttaagtggcacttgtggcaccactcaggcgggtggtctgtcctctggactcttcccacccttccaggatacccag

SEQ ID NO: 344551 - DNA, 780 bp, Homo sapiens
ggtcggtcatctccctgggtatggaaaagtgcctacagtgtattgtttagtgaaaagaaagcaggaagtagactagccagcaaaagattatcctatctttagggaaacatgttagctctaaaatgtggacccaaaaaagatatcagggaagctgttaactgccgcattgggaatggacatttgggaatctttaatattctgtactacatttctgatagctttttaaacacgatcaaaatattttatttgaggcaatagagcttgaacaaagacagacatgtagacagattaagttatctgtgtaaagaggctcacatagcacctgatacctaccaagggctgacagcaaaggtcacccatgttgtgatacactgacttgtgtctgtattgggagacagtagtcaagagaagctgatgggttaagtggcacttgtggcaccactcaggcgggtggtctgtcctctggactcttcccacccttccaggatacccaggacatgtatttcttccccgtcttcctcccttctccctaacacactcctccctgcagctccccacagctgctctctcagactcttctctcctctccacccagcacccccaggctcactctcagcaggtgaatatgccccagactcacgaggtcaaccagagccattgagccctgaggtccaggagaagatatttaaaaattcctcaaattattatgacctattcagtagtttttcacagtagcttgtgagaaaaaaaatgatctccatctctgtgcgctaatatgga

SEQ ID NO: 344552 - DNA, 622 bp, Homo sapiens
cctgtagcagccacttcccagttttgctaattcagttacctctgcaatccattctctccctgcttccaggctggtctccctaaattttaaatcttacactccacacgattctccccgatctctccccttggctgaaaatctcttagtgagtccctttgcctgttaaacaaacccaagctgcttagcactggcaaataaggcccacaagatttgcccttgcctaccttctcaggcacctctttccagccccacatgttaacttcccatttcaggtgaacttgggatgctcagtttctctgagtttccaggttctctcattccaggcattggcatatccaggaatctcctctgacccacccactggttagtcctgtcctgagttcctacagtctcctgggcgtttctttcttctggcccctatgtcactgtgttttatatctgattagtaatctattttattacaaggggcatatcctgggaagaattctaccctgtattcaacccctttctcatttctggacacactgcttgacagtccttctagagcgtgcttttccacatttgataataagttgtgagtcagttgctaccttttcattagttgtcataaggtgttaacatg

SEQ ID NO: 344553 - DNA, 1396 bp, Homo sapiens
gtcgcctggaagcttctttactctgtgtctgaagcctggttgacgggtgcctctctccatggggctagggcttctcacagcttggcagctggattcccagagaggatatcgcagggagagtctggagagcaaatgtgccaagaaagtcagctggaagccacatggccttttatgacctaacctcagaaatcaagctgggtgcggtggctgctggacgcggtggctcaagcctgtaatcccaccactttgagaggctgaggtgggtggatcatttgagaccaggattttgacaccagcctggccaacatggtgaaactccgtctctactaaaaatacaaaaattagctgggtgtggtggtgcgtgcctataatcccagcactttgcgaggctgaggtgggcagatcacttgaggccaggagtttgacaccagcctggtcaagatggtgaaactctgtctctactgaaaatacaaaaattagccaggcgtggtggtgcatgtctacagtctcagctactcgggagctgaagcatgagaattgcttgaacccaggaggcagaggttgcagtgagccgaggttgcgcccctgcactccagcctgggcaacggagcaagactccatctcaaaacaacacacaaaaagagaaatcatagggatgtcacctgcatggtattctctgggttgaaacaggtacaaccccagcttgagttaggggagggggctgatatagtctgaatatttgtcccctctaaatctcgtgttgaaatgtgatccccagctattggagatgaggccaagtgggaggtgtttgggtcatgggggcagatgcctcatgaatggcttggtgccctccctgtggtaatgagtgaattcttgctctattcactcattctttcaaagagctggatctttgaaagaacctggcatgtctgttgctcaccacgtgatcttgtcggccccccttcatcttccactatgataggaagcttcctgcggtcctcactagcagcagatgctggcaccatgcttcttgtacagcctgcagaaccacgagccaaatacacctcttttctttataaatcacccagcctcaggtattcctttatagcaacaaaaacagactaagacagggtcatagaccctgcttcttgatggaggaggacaaagttactttgcagaagagcatgttggatgaagttacttttgtagccattttgggaaaatacaacttgacatttagaaaggtgaagtcctgcagaaggtgtggctgtggaagctgccacagcttcattttcttccttcacttctttctgtttctttcggaaggggagtgagctgacgctcggaaggtgtcttgagattatcatccgctgagggtggaagcggcccccgcaga

SEQ ID NO: 344554 - DNA, 378 bp, Homo sapiens
tgaaggcagcctcttcagccaagttccaaaggccaggtggcccactgtgaaccttgtttaaccacacagaacatatgaatagctacaacaagggatctaacagttaccagaatgttttcagaaaggtgacttcagaagtgccaagcttcaggaagacctggactgagaagggatcagacaactttaggaaagcaggtaccaaacagcccttttacagtttacacacaggccttggtgtcagaaaaatactggtttgagtactggttatgcatcagagatgccactctggacaagctccttatgctctctgggactctgctttctcatctaaaaaatggggatcacctgaggtcaggagtttgagaccagcctggccaa

SEQ ID NO: 344555 - DNA, 392 bp, Homo sapiens
atccagtaaatcccatttctggttatatacccaaaataattgaaattaagatctcagagagatataagcatgcttattgtggcattatttacaataaccaagatattgaaacaacctaaatgttcattgatggataaataagttaaaaagtagtatacacatacaatagaatgtcattcagctttaaaaaaagaaggaaatcgtgtcatatgtgacatcatagatgaaacataaagacatgatggtaagtgaaataatccagttaatgatggacaaatactgcatgactccacttatttgagatgtctaaacagtcaaactcatagaaacaaagagaaaagttttggtttccagtgattaggggcagaagaaaatgaggagatgctgttcaa

SEQ ID NO: 344556 - DNA, 516 bp, Homo sapiens
atgagtgattgaggcataagtttcaatcactgaggtttattaagccagctttagagtgcatctagggaaacacaccagccacagataaacctgtggctatttttctaaagaggtttttgggaggtttaatatgtatgcattccttaaagtggggagaaggtacgtaggaagacaggtaggtaggcagtaaggcaaatgggtacaaccctgtgaaattttagttagtgtccagtaaatctacattttacacaagatatagtgaatgttagaagagaaaaagggagtaaaggaggagccaattatgtgcacatctttaggcaggtgaagaaatgagtcttgtttttgttctgtacctggaagacaagcttccatttggaagaggatgttgcacaattcagcttcatggctttaatttggggggtcctgagatttttttttttaccttccaagagtaaatttcaaatgttctcatcaaaaaatttaagcatttaacgtgaaggataggttaataacttg

SEQ ID NO: 344557 - DNA, 3156 bp, Homo sapiens
  misc_feature (2330)..(2330): n is a, c, g, or t
tcggattggcactcacgtttcccgactccttagtctgtattcttttcaaccttgtctctaatattccatgattccatggttctgatgccattcctcagcgctctgctgttcttgcctgaccaagtggatcaatggtggctctggcatttctataaaggggatttcagggctgcctgctggggagggaggcttgaagctgtgtctgcactgcatcttcacagcactgagaaaatgccagtcattcaggaggacagggcagccctgtcctcgccacagtgcccgcatcttcattggttcacctttgcaggtatcatctgtgacctgtcatccaggctctgagccctgaggataataagtttccctcgaaggtcctgggtttgttggagctttttctccctcttgccatgtccttttcacggtccatcctctgagtttgtgaattatctttcttcgtggcccatgtggcacaagatgaagagtgcatgggcagcttctcccctgacatccctacctccctgacgcttaacccacatagggaagaacattcctgaaacagagacgtcacccagggttgctttctgccacagcaggcactctgcttcgtgcctttctcacttccatttgtaaatgatcttgtctccttccttgtagaaagcttttcagccattccaggctttctctttgggttccatccctctgggattttccacgaattgcatttccttgtagttcattttcatcattttccttgttagggaaatgcacctgagacattggcatgcagcctgattgcccccggcctcccctctgctcattgccagagctacctctgcacagaggagtcactctcctcccactccagggcctctgtcaggggccaggcttgatgctgtcaccagccagctcttcactgctgcccagtgccatattcatatccattgagacaagtccctgggaaatggttgggagccgggggacagccctgcatcctgagatcctaagatcagggaggttctccctgcactcccagctggaaggagactggatcggccaccctcaccaaattcccagattctctgactgaagcaagccagtccttggtttgaatggggaatcaactcagggttataaaatagacgccagccttcttgtaggtagaatctgacttcagacagcaaaagactctaaaacagcttaaattcctgtatatgccttctcctgtgcatgccaccggtcagaccaaaggccacacgccaatcaaggcccaagatcagccaggggtgtttccatgtcctcaagaacttttacaaactgtagctgattgggttccgcccctggagattcgatttagtgggtctggagtgaggcctgggcttcttagaagccccagcggattctaaaatgcagccaggaggaagaacgttgccagaatcccatgaggcacagatgcaaatgtgcatagtgacattgggttgcattatcaatggcaggactgactttataaacctccacatccttactggagctgctgtttgctttttagaaaagtccctcatcagattatcaggaagtcgtgggttttccgtgatcatgctgtggtcagatccagcccaaccagagagccaaaaacaaaacaaacatacaaaacaaacaaacaaacaaacaaaacccaaatccctggcaagccccacgaaatgactgctctgataacattcagcagacaagcctgtttgaaatcatctcagaatcataccagacccaaacccaagaggtcatctggtctatgcatcgactctaggagggtgtattagtccgttttcacgctgctgataaagacacacccgagactgggcaatttacaaaagaaagaggtttcatggacttacagttccacatggctggggaggcctgacaatcatggtggaaggcaaagaggagcaagtcacatcttacgtggatggcggcaggcaaagagacagcttttgcagggaaacttccttttttaaaaccatcagatctcgtgagacttactcactatcacgagaacagcacgggaaagactcgcccccatgattcaattaccgcccaccagtttcctcccacaacacaagggaattgtgggagttaaaattcaagacgaggtttgggtgaggacacagccaaaccatatcagagggtgaggggctatttctccatgttacagacaaggcacgtgaagcctagggacgttccatcacaggcccacaccttgtctcagaattaagaggaaatgcttctggctgccaggggtggggtggggtaggatgcagagcctctccctccaccaccanctccatccttttccctttctctgaaaatctcatttgatgattccccagcctggctgcaaattaaagatttgtagacctgaaagatgctaccgatggttatcagcaccaccaccaccatcgtaacagtaaacatttatggagcgccataattattcataataatttttatgtgttaaacaaatctgacctagctctataaagaaataggccctgttaaccaaaaatattggataaattaaaagtctcctagaagcatctgatgaaaggatctcaagttccataacacacggaccattcagtggtgttgtttctgggcttgattcactgtgggtcacttgaacgatgtcgggggtattgtccacctcccagtgctcagtctgtggcttgtggccagctgttcctctgtggggtctatgttggctgtgttaaggcctgctgcagaaacatctcatttctagcatgtttttctcaagcagtgatcctgtggggtcaagtcttcaatatcaaataatattgataataattatgatagaaataataagaggccaggcaccgtggctcacatttgtaatcccagcactttgggaggcagagttcaggtggatcatttgggcccaggagttcgagatcagcctggtcaacatggtgaaacccagtctctactaaaaatacaacaattagccgggcatggtggtgcacacctgtaattccagctactcgggaggctgaggcaggagaattgcttgaaaccagaaggcagaggttgcagttcgctgagattgcaccactgcactccagcctgggtgacagagtgagactctgtctc

SEQ ID NO: 344558 - DNA, 386 bp, Homo sapiens
tcaaaacactaagcctagtgctttggagatgtgggttctggtctggagtggcagtatggagtgccatctctcaggtcctcatgagcaacacagaggtcacctctccaggcacaggtcgagccacaccactgacacacaagagtcacgtccaaagccatgtgatggacgtggtgggtggttttatcccgaaccatcaatacccggcaccctggctgccccaggttcagcctctcaggggctgcttcactcgctctccacacagctgtgaacattgcaggatgagtcactgtgaaaccacaaactccttggcattggtgaagatgactaaagttataggcaaattagtcactggaaaccttcctgtcctctgtatctgcagcagcctc

SEQ ID NO: 344559 - DNA, 462 bp, Homo sapiens
gcctccacagggcctacatcaacaggactcgcgggccgagcttccaggcgccttgagtggctgggccgggcctccacgttgccctgctgcagggttaggtgggagcgagactggccccactcctgttgactgttccaccagcaccttcagtttgtggaagtggttgtgtccaaagagattttcgtaaaaacatcacaattctaaaacttttttttttttttcacaattctaaaactttatgcatttttggcatttaaaaagccctggcaagtctactgccttatttctcctgctcccttggcctgtgggtctgttcctgtatggttacccactttgttttttttgtttttttttttttttgctgttactgtggctttgtagtatattttaaaatttggtattcgttaactctttttttttctttttttttttttttgaaacagagtctcgttctgttgcctg

SEQ ID NO: 344560 - DNA, 389 bp, Homo sapiens
cagtttctgccattataccaagtttattaatacaccatgcaagagaatcatcaaaatactttatttctttgaaatgagagattttaagatcactgttagtccagaacaagacttgagtatagtctctttcactgcatttccaaattctcaattctcacaactgtggtaattattaccagccttacttgagaaaaaaacatcgaaggtcacacttactggtagagccaggacaagaccataggccttgactctcaagtcctacatcccttgtagcatacacttctacctttcaaaactgagctcggtagctcatgcctgtaatcccaggactttgggaggcggaggcaggcatattgcttgagtccagaagtttgagaagcctaggcaat

SEQ ID NO: 344561 - DNA, 412 bp, Homo sapiens
gttgtgcacatgtatcctaaaacttaaaatataataaaaaagaaaggagatcaatggttgccagggactagggggaaggaagaatgggattaactgcataatagttatagagttttattttgaggtgatgaaaacattttagaactagatagagatagtggttgtaccatattgtgaatgactaattgtaaatgtcactttattgttcactttaaatgattacttttacattgtgtaaatttcaactcaattttaaaaatttaaaaatggaacaagggagaggatttagaaggttctaaatgctaaaagaagttaatgatagaattcaggtagtgcgtatacaggtgttcactgaaatctttcaattttgctgtatgtttgaaattttttataataaaagttcagagggaaa

SEQ ID NO: 344562 - DNA, 594 bp, Homo sapiens
ccacagtgtctcacacatagctttgttattgtgtatataactattggctggtatttcttctcccatagagactgtgaacttctcacatagaggcatggtctattcatggctgccaacacctagcagagcctttagcacacagtagacacttggtattggttttgtgagtggaaattaatttctgccctccagagactgagagtgtaaggatgtgggaaatgttgataagacactcttttagtggaaagagtttctgaagaaaactaattattgtgacatattccaatatatgatagattgaaaggagatgaagatttggagactgaaagttctcacagctttctcacttcacaggctatgtgatcttggaaaagtctgagccttatttcacttattagtcaagagaatgaaatgagaggatgtgtcctggggccataaatgttagatcatttcaacaacatttaatgttagacacttaattaagtgaattctgttttctcagtgactttcattataattagataagtttttttcaggaagaaaaataaagatcctagagtaagtcacagtaaacattttgaatgttttctttaa

SEQ ID NO: 344563 - DNA, 408 bp, Homo sapiens
gctagaaaaccccaggcatatttgttctaagaaaatacttgtgttcggtgaatttaccaacaaagggagcatcagaggatgtgagggaagtctggaatggttgtatcactaagtgagagcagcacagatgtttgtggacctattgagaatgttacagataagaccatttttgaaaagttgtttgcagtgtcattttatgatcttgtgtacattttccaagcgatgtggctattctctaggagggatagtagaaattatttcaattttaatcaaataacctagagaatataacccaaatgactgaaaggaagaaatgtagaaaaagtatataaaataattttttgcattataaaagtttaaagacataaagtaatattactacataaaatctaagttttttactccagc

SEQ ID NO: 344564 - DNA, 2699 bp, Homo sapiens
atccacttccgggctcggcagctagactagcgggggcagcctcagagcgggtgagcttggggacgcacggagaggtgcagctgggccgtccagcatcaaacactagcctccacacgtggaaaagaccctgactcccacagtagactagtcttatgggagtcctggctcttgggccaggctgcattaggaaaatggaaaccagactgtcttcaaattcttctgcctagccttagccattagagagaggtcctgctaaagatggactgcaaatgcgcttgatggaaggagatgtcaattccactgaagtcctcatttctgctgagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcccgctatcagcgctacccggattgcaagcagaggggcctccgcacactgccgcccctggccctattcacatcgaaggagtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatgctgcctggggtgggagcgtcctgctgtcacagacacacaggcatctcctggatgggatccagagggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtgagccttctctgtcttgctgccggccttgataccacccctcacccgcagagtcactgcattccctcccagcctttgaggccgggtgcagtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaataggaaaataataaagttaaaatttcaactgca

SEQ ID NO: 344565 - DNA, 1740 bp, Homo sapiens
tttggttttctgtttctgtgttaactcacttaggatactggcctccagctgcatccatgttgctgcagaggacatgatttcattcttttttatggctgcataatacttcatgggtgctgtgccgttcctggtcagtgccacctctggcaccactgtgctaggggcctttgaccccctggaggcaattgctgatgtgtgccagcgtcatgggctatggctgcatgtggatgctgcctggggtgggagcgtcctgctgtcacagacacacaggcatctcctggatgggatccagagggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtgagccttctctgtcttgctgccggccttgataccacccctcacccgcagagtcactgcattccctcccagcctttgaggccgggtgcagtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaataggaaaataataaagttaaaatttcaactgca

SEQ ID NO: 344566 - DNA, 2230 bp, Homo sapiens
  misc_feature (102)..(102): n is a, c, g, or t
  misc_feature (119)..(119): n is a, c, g, or t
atccacttccgggctcggcagctagactagcgggggcagcctcagagcgggtgagcttggggacgcacggagaggtgcagctggggtggctcacacctgtantcccagcacgttgggangccgaggagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcccgctatcagcgctacccggattgcaagcagaggggcctccgcacactgccgcccctggccctattcacatcgaaggaggtggggaagaggcacaggcccaaccctgggctcctgattctaatctccagccatgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaagggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaataggaaaataataaagttaaaatttcaactgca

SEQ ID NO: 344567 - DNA, 619 bp, Homo sapiens
gtactattcaaatttatttatttatttagagacagagtttcactttgtcacccagactggagttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaataggaaaataataaagttaaaatttcaactgca

SEQ ID NO: 344568 - DNA, 664 bp, Homo sapiens
ctcacccccccttcttgtattcttatggttgtatattttcagtttctgtctttatcttagctgcagttaatttttgtcaatgatgagaaatagtgagaaatgccacacggacctgtgatgcagtggaagaggtagcctaaagtcagaaagtcagtgatctaggcttgttcccatgtcacctttgtaattttggacaattagttcaccttctttcagctaagaatcctcatcttgaaaacaagaatgaataaatacctatttaggctaatttctaatactattgtgaaggtcaaataagataataaatgagaaggaaaaacaccctttgcaaatctattatcattactacagattcttggttgatgcaaatcaaatgtaagtagaatgcagcattttttccagtacctgcaaatcattgattgatttaacaaatgtttatgtaatgcctctgtgcaagtccctgggggaggggagaggacaatcaagaagatggaaactaacatttgaggggtcctgctaaagatggactgcaaatgcgcttgatggaaggagatgtcaattccactgaagtcctcatttctgctgtaggtgatattatgtcgtgactttaggagaagtaatggtgataccaaaagaaaaaaaaaactgtatgatgaaaaaaaaa

SEQ ID NO: 344569 - DNA, 3188 bp, Homo sapiens
atccacttccgggctcggcagctagactagcgggggcagcctcagagcgggtgagcttggggacgcacggagaggtgcagctgggtgagtgggcggcgccgtgcgccgagggcatggaggagggagcgctgaggccggcgcgtgcgccgtggccggggcgcgccccggccgccatcgagactgagggcaggaccctcggcccttcgatgattgtacgctgggtgctcgatgggaggagggtttgctgggtgagctggttcagactccttgaaaaatcatcgtcactctttcttcctcgcggacgtcctgcccatcgctctgagccggcgccccaagtagagccagagtagttcgtacccagccttttcacgtaactcggccgaggtggttcttctccgaattttttccgtcaggcccagattagcagattttggggtcagctgggagaggcgttaacttttcttcgcacactcttgctttgtgcgctcaaccacagtctgaattctcgcagaggcgttccttgagtagcccttggccacactgctcacctccctgcagaagtcaaagccccagccctcctctgcgaatcccgaggccagcctggttggttaccttctccccttcgccctttactccaggccgtccagcatcaaacactagcctccacacgtggaaaagaccctgactcccacagtagactagtcttatgggagtcctggctcttgggccaggctgcattaggaaaatggaaaccagactgtcttcaaattcttctgcctagccttagccattagagagaggtcctgctaaagatggactgcaaatgcgcttgatggaaggagatgtcaattccactgaagtcctcatttctgctgagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcccgctatcagcgctacccggattgcaagcagaggggcctccgcacactgccgcccctggccctattcacatcgaaggagtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtgagccttctctgtcttgctgccggccttgataccacccctcacccgcagagtcactgcattccctcccagcctttgaggccgggtgcagtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaataggaaaataataaagttaaaatttcaactgca

SEQ ID NO: 344570 - DNA, 2346 bp, Homo sapiens
gtagagcaagctcgaacgaccagttatgggcgtagctgcctgcacaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcccgctatcagcgctacccggattgcaagcagaggggcctccgcacactgccgcccctggccctattcacatcgaaggagtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtgagccttctctgtcttgctgccggccttgataccacccctcacccgcagagtcactgcattccctcccagcctttgaggccgggtgcagtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaataggaaaataataaagttaaaatttcaactgca

SEQ ID NO: 344571 - DNA, 929 bp, Homo sapiens
atccacttccgggctcggcagctagactagcgggggcagcctcagagcgggtgagcttggggacgcacggagaggtgcagctgggtgagtgggcggcgccgtgcgccgagggcatggaggagggagcgctgaggccggcgcgtgcgccgtggccggggcgcgccccggccgccatcgagactgagggcaggaccctcggcccttcgatgattgtacgctgggtgctcgatgggaggagggtttgctgggtgagctggttcagactccttgaaaaatcatcgtcactctttcttcctcgcggacgtcctgcccatcgctctgagccggcgccccaagtagagccagagtagttcgtacccagccttttcacgtaactcggccgaggtggttcttctccgaattttttccgtcaggcccagattagcagattttggggtcagctgggagaggcgttaacttttcttcgcacactcttgctttgtgcgctcaaccacagtctgaattctcgcagaggcgttccttgagtagcccttggccacactgctcacctccctgcagaagtcaaagccccagccctcctctgcgaatcccgaggccagcctggttggttaccttctccccttcgccctttactccaggccgtccagcatcaaacactagcctccacacgtggaaaagaccctgactcccacagtagactagtcttatgggagtcctggctcttgggccaggctgcattaggaaaatggaaaccagactgtcttcaaattcttctgcctagccttagccattagagagaggtcctgctaaagatggactgcaaatgcgcttgatggaaggagatgtcaattccactgaagtcctcatttctgctgtaggtgatattatgtcgtgactttaggagaagtaatggtgataccaaaagaaaa

SEQ ID NO: 344572 - DNA, 2174 bp, Homo sapiens
atccacttccgggctcggcagctagactagcgggggcagcctcagagcgggtgagcttggggacgcacggagaggtgcagctgggtgagtgggcggcgccgtgcgccgagggcatggaggagggagcgctgaggccggcgcgtgcgccgtggccggggcgcgccccggccgccatcgagactgagggcaggaccctcggcccttcgatgattgtacgctgggtgctcgatgggaggagggtttgctgggtgagctggttcagactccttgaaaaatcatcgtcactctttcttcctcgcggacgtcctgcccatcgctctgagccggcgccccaagtagagccagagtagttcgtacccagccttttcacgtaactcggccgaggtggttcttctccgaattttttccgtcaggcccagattagcagattttggggtcagctgggagaggcgttaacttttcttcgcacactcttgctttgtgcgctcaaccacagtctgaattctcgcagaggcgttccttgagtagcccttggccacactgctcacctccctgcagaagtcaaagccccagccctcctctgcgaatcccgaggccagcctggttggttaccttctccccttcgccctttactccaggccgtccagcatcaaacactagcctccacacgtggaaaagaccctgactcccacagtagactagtcttatgggagtcctggctcttgggccaggctgcattaggaaaatggaaaccagactgtcttcaaattcttctgcctagccttagccattagagagaggtcctgctaaagatggactgcaaatgcgcttgatggaaggagatgtcaattccactgaagtcctcatttctgctgagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcccgctatcagcgctacccggattgcaagcagaggggcctccgcacactgccgcccctggccctattcacatcgaaggaggtggggaagaggcacaggcccaaccctgggctcctgattctaatctccagccagctaagtagagaccttccaggtcttctccctgccctccctacatcctccaaggccagcctgcccccaggcggatgtgcttccttccaatcaaggaggtcaagtaactgctcctgttcacattgccttctgtttgggggcagaggaggggccgtgagtgcagtggacacagtccatactcttcctactcaagagtgtggtctgtggaccagcagcattggtatgacctggggcttgttagaaatgcagaatctggccgggcacggtgactcacgcctgtaatcccagcactttgagaggctgaggtgggtggattgcctgagctcaggagtttgataccaccctgggaaacatagtgaaataaatagggaaaagcaatatcaggaaaagtattaaggagggatatttaatctattccattcaaaataacctttaaagtctttactgttatgatccttaacaaatacaacatacattcctaaagatttttccaagtcattctgtaactaaggagacaatatgatctttcaactagtttctcatctaattatgcttttacttcagcatggacgtactctgacctcaaccttccccagcaggttattttttgttacccctgcgtgacacctcagt

SEQ ID NO: 344573 - DNA, 1341 bp, Homo sapiens
ctcacccccccttcttgtattcttatggttgtatattttcagtttctgtctttatcttagctgcagttaatttttgtcaatgatgagaaatagtgagaaatgccacacggacctgtgatgcagtggaagaggtagcctaaagtcagaaagtcagtgatctaggcttgttcccatgtcacctttgtaattttggacaattagttcaccttctttcagctaagaatcctcatcttgaaaacaagaatgaataaatacctatttaggctaatttctaatactattgtgaaggtcaaataagataataaatgagaaggaaaaacaccctttgcaaatctattatcattactacagattcttggttgatgcaaatcaaatgtaagtagaatgcagcattttttccagtacctgcaaatcattgattgatttaacaaatgtttatgtaatgcctctgtgcaagtccctgggggaggggagaggacaatcaagaagatggaaactaacatttgaggggtccctgttttctattagtttacttaatgaaggaaaagacttagttctctccacccaggagagtacagtctagaagcagagaaaagattgtatacataggagcgtttgtgcctttattaatgtgggtgtggagccactagggtttgttgattgggagatagcacagagtactttagctttctaaccataaacctggctgagagcgcttcaggagacaattgcctagatccctttgtccccaggcaggcctcctcctgtgtgaccttccctaactccctcttccctcaggcccactccatcacttattcaaatagcattgcaatgactcctgctgagtcttttcctgcaccagctctctattgccttaaggagagccttagtgttttgtccttgaagcctgtcctgggccagttgaactttcctgcctttccatggtgacctctcaactccctcttgtggcaatttccctttattttacatgcaggtctctcttgccagcctgttagctggagcccacagggcagatgcagcacctagggtaatgccagccaggcgctcagaagtagacaacactcagtcaatgtttgctgaacaaactgaacccattcccttccctgagagccagcgggggttgaggggttgcgtaatagagatgagcagtgtgtggctccctttgccttccattagacctttgataacagtggattgaggagttgggaaaccacatgatgtgcaagggacattccttgagcctgatgatttgtatattttagaattcttgtacccccttaattctccagcctgggtgacagagggagactcttgtctcca

SEQ ID NO: 344574 - DNA, 1287 bp, Homo sapiens
ctcacccccccttcttgtattcttatggttgtatattttcagtttctgtctttatcttagctgcagttaatttttgtcaatgatgagaaatagtgagaaatgccacacggacctgtgatgcagtggaagaggtagcctaaagtcagaaagtcagtgatctaggcttgttcccatgtcacctttgtaattttggacaattagttcaccttctttcagctaagaatcctcatcttgaaaacaagaatgaataaatacctatttaggctaatttctaatactattgtgaaggtcaaataagataataaatgagaaggaaaaacaccctttgcaaatctattatcattactacagattcttggttgatgcaaatcaaatgtaagtagaatgcagcattttttccagtacctgcaaatcattgattgatttaacaaatgtttatgtaatgcctctgtgcaagtccctgggggaggggagaggacaatcaagaagatggaaactaacatttgaggggtccctgttttctattagtttacttaatgaaggaaaagacttagttctctccacccaggagagtacagtctagaagcagagaatagggtttgttgattgggagatagcacagagtactttagctttctaaccataaacctggctgagagcgcttcaggagacaattgcctagatccctttgtccccaggcaggcctcctcctgtgtgaccttccctaactccctcttccctcaggcccactccatcacttattcaaatagcattgcaatgactcctgctgagtcttttcctgcaccagctctctattgccttaaggagagccttagtgttttgtccttgaagcctgtcctgggccagttgaactttcctgcctttccatggtgacctctcaactccctcttgtggcaatttccctttattttacatgcaggtctctcttgccagcctgttagctggagcccacagggcagatgcagcacctagggtaatgccagccaggcgctcagaagtagacaacactcagtcaatgtttgctgaacaaactgaacccattcccttccctgagagccagcgggggttgaggggttgcgtaatagagatgagcagtgtgtggctccctttgccttccattagacctttgataacagtggattgaggagttgggaaaccacatgatgtgcaagggacattccttgagcctgatgatttgtatattttagaattcttgtacccccttaattctccagcctgggtgacagagggagactcttgtctcca

SEQ ID NO: 344575 - DNA, 412 bp, Homo sapiens
cttctgtttgggggcagaggaggggccgtgagtgcagtggacacagtccatactcttcctactcaagagtgtggtctgtggaccagcagcattggtatgacctggggcttgttagaaatgcagaatctggccgggcacggtgactcacgcctgtaatcccagcactttgagaggctgaggtgggtggattgcctgagctcaggagtttgataccaccctgggaaacatagtgaaaccccctctttactaaaatacaaaaaattagccaggcatggtggtgggcacctgtagtcccagctgcttaggaggctgaggcacgagaattgcttgaacctgggaggcggaagttgcagtgagccgagatgacaccactgcactccagcctgggtgacagagggagactcttgtctcc

SEQ ID NO: 344576 - DNA, 1993 bp, Homo sapiens
gcttggggacgcacggagaggtgcagctggggtggctcacgcctgtggtcccggcgcgttgggaggccgagagagggaatgactctgctctgccacagatcctgatggctgactcagaagcactcccctcccttgctggggacccagtggctgtggaagccttgctccgggccgtgtttggggttgttgtggatgaggccattcagaaaggaaccagtgtctcccagaagtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatgctgcctggggtgggagcgtcctgctgtcacagacacacaggcatctcctggatgggatccagagggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtgagccttctctgtcttgctgccggccttgataccacccctcacccgcagagtcactgcattccctcccagcctttgaggccgggtgcagtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaataggaaaataataaagttaaaatttcaactgca

SEQ ID NO: 344577 - DNA, 2411 bp, Homo sapiens
atccacttccgggctcggcagctagactagcgggggcagcctcagagcgggtgagcttggggacgcacggagaggtgcagctgggagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcccgctatcagcgctacccggattgcaagcagaggggcctccgcacactgccgcccctggccctattcacatcgaaggagtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatgctgcctggggtgggagcgtcctgctgtcacagacacacaggcatctcctggatgggatccagagggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtgagccttctctgtcttgctgccggccttgataccacccggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaataggaaaataataaagttaaaatttcaactgca

SEQ ID NO: 344578 - DNA, 3030 bp, Homo sapiens
atccacttccgggctcggcagctagactagcgggggcagcctcagagcgggtgagcttggggacgcacggagaggtgcagctgggtgagtgggcggcgccgtgcgccgagggcatggaggagggagcgctgaggccggcgcgtgcgccgtggccggggcgcgccccggccgccatcgagactgagggcaggaccctcggcccttcgatgattgtacgctgggtgctcgatgggaggagggtttgctgggtgagctggttcagactccttgaaaaatcatcgtcactctttcttcctcgcggacgtcctgcccatcgctctgagccggcgccccaagtagagccagagtagttcgtacccagccttttcacgtaactcggccgaggtggttcttctccgaattttttccgtcaggcccagattagcagattttggggtcagctgggagaggcgttaacttttcttcgcacactcttgctttgtgcgctcaaccacagtctgaattctcgcagaggcgttccttgagtagcccttggccacactgctcacctccctgcagaagtcaaagccccagccctcctctgcgaatcccgaggccagcctggttggttaccttctccccttcgccctttactccaggccgtccagcatcaaacactagcctccacacgtggaaaagaccctgactcccacagtagactagtcttatgggagtcctggctcttgggccaggctgcattaggaaaatggaaaccagactgtcttcaaattcttctgcctagccttagccattagagagaggtcctgctaaagatggactgcaaatgcgcttgatggaaggagatgtcaattccactgaagtcctcatttctgctgagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccatgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatgctgcctggggtgggagcgtcctgctgtcacagacacacaggcatctcctggatgggatccagagggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtgagccttctctgtcttgctgccggccttgataccacccctcacccgcagagtcactgcattccctcccagcctttgaggccgggtgcagtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaataggaaaataataaagttaaaatttcaactgca

SEQ ID NO: 344579 - DNA, 3147 bp, Homo sapiens
atccacttccgggctcggcagctagactagcgggggcagcctcagagcgggtgagcttggggacgcacggagaggtgcagctgggtgagtgggcggcgccgtgcgccgagggcatggaggagggagcgctgaggccggcgcgtgcgccgtggccggggcgcgccccggccgccatcgagactgagggcaggaccctcggcccttcgatgattgtacgctgggtgctcgatgggaggagggtttgctgggtgagctggttcagactccttgaaaaatcatcgtcactctttcttcctcgcggacgtcctgcccatcgctctgagccggcgccccaagtagagccagagtagttcgtacccagccttttcacgtaactcggccgaggtggttcttctccgaattttttccgtcaggcccagattagcagattttggggtcagctgggagaggcgttaacttttcttcgcacactcttgctttgtgcgctcaaccacagtctgaattctcgcagaggcgttccttgagtagcccttggccacactgctcacctccctgcagaagtcaaagccccagccctcctctgcgaatcccgaggccagcctggttggttaccttctccccttcgccctttactccaggccgtccagcatcaaacactagcctccacacgtggaaaagaccctgactcccacagtagactagtcttatgggagtcctggctcttgggccaggctgcattaggaaaatggaaaccagactgtcttcaaattcttctgcctagccttagccattagagagaggtcctgctaaagatggactgcaaatgcgcttgatggaaggagatgtcaattccactgaagtcctcatttctgctgagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcccgctatcagcgctacccggattgcaagcagaggggcctccgcacactgccgcccctggccctattcacatcgaaggagtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtgagccttctctgtcttgctgccggccttgataccacccctcacccgcagagtcactgcattccctcccagcctttgaggccgggtgcagtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaataggaaaataataaagttaaaatttcaactgca

SEQ ID NO: 344580 - DNA, 1955 bp, Homo sapiens
atccacttccgggctcggcagctagactagcgggggcagcctcagagcgggtgagcttggggacgcacggagaggtgcagctgggtgagtgggcggcgccgtgcgccgagggcatggaggagggagcgctgaggccggcgcgtgcgccgtggccggggcgcgccccggccgccatcgagactgagggcaggaccctcggcccttcgatgattgtacgctgggtgctcgatgggaggagggtttgctgggtgagctggttcagactccttgaaaaatcatcgtcactctttcttcctcgcggacgtcctgcccatcgctctgagccggcgccccaagtagagccagagtagttcgtacccagccttttcacgtaactcggccgaggtggttcttctccgaattttttccgtcaggcccagattagcagattttggggtcagctgggagaggcgttaacttttcttcgcacactcttgctttgtgcgctcaaccacagtctgaattctcgcagaggcgttccttgagtagcccttggccacactgctcacctccctgcagaagtcaaagccccagccctcctctgcgaatcccgaggccagcctggttggttaccttctccccttcgccctttactccaggccgtccagcatcaaacactagcctccacacgtggaaaagaccctgactcccacagtagactagtcttatgggagtcctggctcttgggccaggctgcattaggaaaatggaaaccagactgtcttcaaattcttctgcctagccttagccattagagagaggtcctgctaaagatggactgcaaatgcgcttgatggaaggagatgtcaattccactgaagtcctcatttctgctgagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcccgctatcagcgctacccggattgcaagcagaggggcctccgcacactgccgcccctggccctattcacatcgaaggagtgtcactactccatccagaagggagctgcgtttctgggacttggcaccgacagtgtccgagtggtcaaggctgatgagagagggaaaatggtccccgaggatctggagaggcagattggtatggccgaggctgaggtgagtcagtgaggctcgctggggtgatatagcctccaactgtcttggagggttatttgggctctcctttctcaaggcatccttcatccctctcgtctccatgcccatctcccctgtgggctgaagtgaccatggagagcctgggggtgaggacactacattgctttctggggctctgcccagacacctacgccgggttggattctgagaggcagggctgagtgagggagcgagtcccaggcagcaccacagggagggtgctgggggcctgcgctgtagtgtggaaggttcctgtgggctgtgagggtctgcgcagggagaggctgagga

SEQ ID NO: 344581 - DNA, 1705 bp, Homo sapiens
cgcaccttgggctggaatgtgtctccaggcaaaagtacaggcaattataaggctctcctcatttgtttcttctctctcagggaccacagttctgtactgcttgttgaccaatgcttgaaaactgttatttcatatcttttgtccagtttttaaattatttacagtgggaggattagtccagtcccacttcctccagaaagagtaattctggaatctcatttttattttctaatgcaacatagtggtaagacctccactctgaattagaaagacctgaatttgaattctagctctgaattgaataaatagcttcttaatattgtggttttcttttaagtggggataatgaaattccctatctcctgagattattgtgaagatttactgaattaggcattgtattaatttactgtggctgctgtaacaaattactacaaactgggtgacttaaaacacagttttggagaccaaaagtccaaaacagtttcactgagctgaaatcaaggtgtcaataggaccacggtccttcgcgggccctaggggggattcattccttgcctcttccaccttctgatggccacaggcctttggcttatggctgcatcactccaatctctgccttcatagttacattcttttctcctcttctctctgtatcaaattcccctctgcccctttcttataaggattgcatttaggacccgcccagataatctaggataatcccctcatttttaagatccttaatcacatctgcaacccatttttcttacaaggcaacatttacaagtttcagggattagaacatgatgtctttctgtggccattatttagcctactacgaggtgataaagcatttgacacacattcactaataatcaaaacatttaacaaacactacaaggcaccaaggcaccaacctatcagataataatcaccaactaataagaatggatgctggccacaaacccccctaacagtgcctttggctgaatagcagccctgtacttgccatatgccagcatctcacacatcctatacaccgaataaatatgagttcattgagatccgacttaagtcatttctactacttcttaaatgtctgggcatgttctttggtcatttatttgcagggtcttgtgttctgcttctctatttgtctgagtacttcatatagggaggatgctaacattcgcatatttgtgacaaatgtttgcattatattgtgttaatattttctaaatcttatacttgattatatgtatctagataatatgttcttaaccttcatttttaaatatatacatttaaattgagtatatggcttattatctcattaggttgtattaaacttaatgaaataaatatactgatatacactaactaggctttttgaatgcaagattcttctttaaatctttttctttgcaaacaaaaggatctctgttttccccaaagataagcaaatttgtcatggccagtttttattatgcttaaacatgcacttataaaatagagatgttagagttaaatgtgaattgcaaagacttgttttttttttttttttttttggagacagtgtctctgtagcccaggctggagtgcagtgatgcaatcacagctcactgcaacctcaaactcctggacttaagcaatcttccagtctcagcctcccaagtagctgggggaatacagggacacacca

SEQ ID NO: 344582 - DNA, 918 bp, Homo sapiens
cgcaccttgggctggaatgtgtctccaggcaaaagtacaggcaattataaggctctcctcatttgtttcttctctctcagggaccacagttctgtactgcttgttgaccaatgcttgaaaactgttatttcatatcttttgtccagtttttaaattatttacagtgggaggattagtccagtcccacttcctccagaaagagtaattctggaatctcatttttattttctaatgcaacatagtggtaagacctccactctgaattagaaagacctgaatttgaattctagctctgaattgaataaatagcttcttaatattgtggttttcttttaagtggggataatgaaattccctatctcctgagattattgtgaagatttactgaattaggcattgtattaatttactgtggctgctgtaacaaattactacaaactgggtgacttaaaacacagttttggagaccaaaagtccaaaacagtttcactgagctgaaatcaaggtgtcaataggaccacggtccttcgcgggccctaggggggattcattccttgcctcttccaccttctgatggccacaggcctttggcttatggctgcatcactccaatctctgccttcatagttacattcttttctcctcttctctctgtatcaaattcccctctgcccctttcttataaggattgcatttaggacccgcccagataatctaggataatcccctcatttttaagatccttaatcacatctgcaacccatttttcttacaaggcaacatttacaagtttcagggattagaacatgatgtctttctgtggccattatttagcctactacgaggtgataaagcatttgacacacattcactaataatcaaaacattaacgaccttgcatccgaggggatcctctga

SEQ ID NO: 344583 - DNA, 686 bp, Homo sapiens
ggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactggtgagactgggaacgctgggctggggggccagggtcgggggaattatgtgttcatctgttcatctatctgtccatcctcaaagaggactgagcaccatttatgggcaaagcattgttctaggcgctatagagcaaacaggtgaaagaggcctggtccctgccct

SEQ ID NO: 344584 - DNA, 761 bp, Homo sapiens
ggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagt

SEQ ID NO: 344585 - DNA, 545 bp, Homo sapiens
ggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcctcccatcttgctcctgcggtc

SEQ ID NO: 344586 - DNA, 708 bp, Homo sapiens
tccaagatccagatgctgtcatgtttggtgtatggttagggaacacgtcctagttcatgaatgctttttctctgtgccctcacttggcagaaggggtgaaggagatctggggtctgttgtatagagcactaagcactaatcccattcattagggcttcgctctcatgaccaactacctgtaaaaatcccccctcctaataccgtcacatctgtgattggctttcagcatataaattttggggaagacaaacattcagaccacagcagatgtttattatttcctttcctctgcttgctttgggtttatgtcactcttcttttatctagttgcttaaggtagaagtcaaagtcattgatttaagactcttctaatgtagacattcagcagtgctaaaaatttgtattcaagtacagctgtagctgcattccacaaattctggttgatgaatttttattcagttcagaatattttctattttctatttctattttcattacctgtttgacccagggttatttagatgtgtgttacttagtttccaaatatttgtgtatttcccagagttatttttgttatcggtctttaatctgattgatttgtggtcagggcacatactttgtatgagttaaatccttctgactcaatcctttaattgagagttgttgtatggcctaaaatatggtctattttggtaagtgttccgtggg

SEQ ID NO: 344587 - DNA, 759 bp, Homo sapiens
gcagctgccccaggccaaatttctgcctgcctgccagcagcctcaacaggcacagctcctccctcacagtggcccatttaggcccaactcatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggcgaagctcctgcctttcggcagcctctccaggcccagctcctcctgcctcccagtggcctctttcggcccagcccagctcatgcctcccggcggccttcccaagccccgcttttgactttcggtggcctctgcaggcctcgacaaggcccagcctcctgcctcccgaaggcctgcacaggcccagcctctgcctcacagcggactctccacgcccagctagctgttgcttcactgcggcctcccgagtccaaagctcctgcctctcggccgcttcggcaggcccagctcccgcctgccagtggcctcttcaggcccatggggctcattcctgacaacggcctttccaggcccagtttttcccttccggcggcctctccgggcccagaacctcctcaagtcagcctctccagacccacttgcaccctccgggcattctctccgggcccagctcttcttcctggttgggtctccaggcccgattcctgcctct

SEQ ID NO: 344588 - DNA, 435 bp, Homo sapiens
atgtgggtctgaagagctgtgagagacttcggggtctacaaacgcaggcgggagctgagccaaaagagctggttggctgggaggtgggagatgcagccgggaggaacagctcccgtcagcctctacagtcccaacgtctgcctcacagcagattcttcaggcccagcatctgcctcactgtggaccccccaagccaagctcccaacctttcagcagcttctacacacccactcccgcctgccagtggcctcttcaggcccatggggctcattcctgacaacggcctttccaggcccagtttttcccttccggcggcctctccgggcccagaacctcctcaagtcagcctctccagacccacttgcaccctccgggcattctctccgggcccagctcttcttcctggttgggtctccaggcccgattcctgcctct

SEQ ID NO: 344589 - DNA, 414 bp, Homo sapiens
atgtgggtctgaagagctgtgagagacttcggggtctacaaacgcaggcgggagctgagccaaaagagctggttggctgggaggtgggagatgcagccgggaggaacagctcccgtcagcctctacagtcccaacgtctgcctcacagcagattcttcaggcccagcatctgcctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcc

SEQ ID NO: 344590 - DNA, 418 bp, Homo sapiens
ctcagtcccccgagtagctgggagtacaggtgcgtgtcaccgtgctcggctaattttttgtattttttctagagacaggttttgccatgttgccgagtttggtctcaaactctgagcttcaagtgatcctcacccttcatcctcccaaagtgctgcgacgacaggtgtgggctaccatgcctggccaagaaggtcatttttatcatttgattctacagctgctactcacggttacactgtgagaatgtcctgtataaaagcccttatttgggccaggtgtggtgacgctcgcctgtaatcccagcagtctgggaggccaaggcaggtggatcacttgaggtcaggagttcaaaaccagtctgggcaacattggtaaaaccccatctccaccaaaaaaaatagaaaaatgagccaggca

SEQ ID NO: 344591 - DNA, 156 bp, Homo sapiens
cagtccctacactatgcagatctgcccaggtgtaaacactatctcagcccctagtgttcttctatacatagcatatggcattcaataaaaaattacaacacacatataaaagcaagggtgggaggggggaaagacattgttaaaacaatctacaga

SEQ ID NO: 344592 - DNA, 767 bp, Homo sapiens
ccttttgttttattgtgtaacattgatgtgtgttacagcctaggtagtctcaaaataggaaattatcttgctggtttttccagctgggcaatttatatttatttagtcttccatttattccatttaaatgttaatttattttgccatttactgttcaaaggaaaaggagagctctattcagaagaccatatcagggatcctgtagcatttctcatatttctgtattttttgccactgtggttctttcttgtttctgtgccatgacccctttgaggaactgaagaatgctcattgtatatatgtttagaataggacaagtaataacaaacttccaaatctcaatggcttaacaaaacagaggtttatttcttgttgacatcacagactactgtgaatcaggtgatcttcctcaatcttacagccgtgcctatcgaatatgaggttccaagattgtgatacaaagatacggcaggatgtctcaggggatgatttttaggatctaagcttagaagtagcttacatcacttctgctcaaattctgttagctaaaactcactgtcatcttcccaaatattatctgtgtgctctttgctatttcccagacccctgttcatggagtttctgctacattccatctttctagtcaccaaacagctcttggcttctttctttacccatgcataacacacttagtctctctccttagggagaaatcccaaagtcccattccatcattgcaccccggccccaaatccatgatctccaga

SEQ ID NO: 344593 - DNA, 526 bp, Homo sapiens
attccaacagtaaataaaatgaaaatagcttaagaaaactaataaaagcaaaccaagcaaagctaagacaattttgtattccctttctgctttcacctcttgtgcctatcttgctcctaaccacttagactcccccagataagctaactgggtccatgagaatttcctgaaaatgcctatcctaaagtcaaatggagaataatgattctcaagacacacccctcccttgttctttcttttcccttctactcccacatatttaaatctcaaaatttcttaggtggcagattcagagaaggaaaaacggaagaaaaatctatttctaagattctgcgtaccaaagactaaatctcagagtactttagaccagagtattccttttttgggaaaagctttatttatgggttgataggtaacaaataggtaagtactctctattccacttgaagtaataatgaacagatggggccagatgacttgggctagaaatctctacatcctaattttttccctcaaacctagacca

SEQ ID NO: 344594 - DNA, 278 bp, Homo sapiens
tgtacaatttttcagacaacagtttcaaacatgttttcacttcatgaaagttttcttgaaagacagttaatgtttgctctgttcctctgaatattgtttctttggagattcctactataaaaacactgtatttctattgcctattatcaatatttgccactttctcatgagcccttttagacttttaaaatgttcttgtcttttatcttcaatttctctgaagatgttttaattttatttatttttaaattgctgttttctgtagccataaggttttg

SEQ ID NO: 344595 - DNA, 419 bp, Homo sapiens
ggtttcgcaggacttagtcataggcacgtttcataatactctcctgcacgtttcataatactctcctgcatgcccctaaacacagcacctcgagcattgaactctgacatcagttgagaagatgatacccctctagctggtgcttaagccttctggcttaagcctggacttgatctctgacccctttctcttccagactgcaccctgctttcatttccaatccgtctccaaggcctgttgcttctacctctggaagaccttgactccacctgataacctctatctccgctgccatccgcgaggttcaagctgtcatcctccctctcctggaccattccagtagccttcttacatgagggctacacttctaccctgccccttccaaaccagagcacccactcagatcctgccaacccttg

SEQ ID NO: 344596 - DNA, 445 bp, Homo sapiens
ccctcatttatttttggttttggatgaggaaagtcatgttttctaagtcctctcccctaataaaacctacccaacaatagtgctttgaaaagtggtagttatcttgaagatactcttgccaaatgcaaagataaacattctttttgtctgctttataaatatgaaatatgccagatctatagtattttaatgtgcatctactttaaatgagtcatcttggggtttttataattcccttacattcttgcccctctacacttgaaataacaaaatgccttaattttatagattagttctcttatagtagacaggcagctatatgcagcaaaaccaataaagttatttttcaactttcatagttgtaaaatattttatagcaatacaaaacagctaagaaaacatgccacattttattttagcattttcaaataatttgtttttggtg

SEQ ID NO: 344597 - DNA, 538 bp, Homo sapiens
atgtgccaaacatggtaccaggccatgggcacacactgacaaataagacagactttgtcattatggagctaacagtttagtgggagatagacaaaagtaaaagataatttcactgcatgtgataaggacaatgatggagaaatgcatggcatatacagtgtcgtatcctgtgctttgcactttggtttttgtttttgttttcattttgagatgtagtttcgctctgttgccaagactggaatgcaatgatgtgatctcagcacaccacaacctccacctcccgggagaatcacttgaacgtaggagacaggggtttcagtgagccgagatcatgccattgcactccagcctgggcaacaagagcaaaactctgtctccaaaaaaaaaaaaaaaaaaaaagaatatgcaatgtagacttaatgcaaattgacaagtatgcattaccagtaatgtgtttcaaggaatacaaaaaaaggacacattttacttgccctccagaggcctacagtctcactggggggaaaaaagtgacatacat

SEQ ID NO: 344598 - DNA, 1414 bp, Homo sapiens
tgagacagagtctttctcttgtcgcccaagctggcgtgcaatggcacaatcttggttcactgcaacctccacctcctgcattcaagcaattctcttttctaagcctcccaagtagctgggatttcagatgtgtgccaccacaccacatagtccctctccacagagatggttgagaaggctgatggaaaagccagatacttgttctacagctttccctgacactagtatatcatccacatactggagcatagatatacactttgggatgctcatcttttctaacacctcctcaagaatttggccaaaccagttaggagaatctgtaaatccttggggtaagactgtccagcagtattgttgttttcacccagagtgagaatcttcccattcaaaagtgaatatatcctgactatcttcagctaaaggacatgcccagaaggcatctttcaggtctatttctgtaaaccactgatggtcatatggaattttgctgagaatagtatatggattgggaaccacaggatgagtggtttgaaccgtttgactaatggcttgaagatcttctacaagtcagtatcacccatctgactactttacaagtaatattggagtagtatagggagacatgcaccgttcaagtagcccatctcagataaggctctcaattagaggttttaaacctaatctaccttctaagggaattggacattggtttcttttcactgtttccctgggagtttttaactttatgtgaattggaggaacttgtagcttccttcaatttccctcccttgaccactcattagcattgatgtagctttcttctgctgtagtaaacggtttaatgaagtgatgatcccttctgggcttacacgcaagcctatacctaactttgccattaggccacttcctaacaagtttgtcccagccttaggaagtagcaaaaatttaacattggttgatcgggtttcaaatctgacttctgttttttctgagactttggctttaaatccttcccctttgactcctaaaacttgaagttcttctaataaacaatttatattagagggcacaaaacaaacagaggagtgggaagctcctgagtctattagaaaagtaataagttcggctgggtgccatggctcacacctgtagtcccagcactttgggaggccaaggtgggcggatcacctgaggtcgagagttcgagaccagcctgacccacatggagaaaccccatctttactaaaaatacaaaattagccagactttgtggcacatgcctataatactagctacttgggaaggctgaggcaggagaatcatgtgaacctgggaggtagaggttgcagtgagccaagatcacgccattgcactccatcctgggcaacaagaacaaaactctgtctcaaaa

SEQ ID NO: 344599 - DNA, 205 bp, Homo sapiens
gtgcccaacaccttgatcagtgcctgctttgtagtaggcattcaaatactgtggactggatgaatggagtcacttcccttccaacctgcacaccaacgtggttgaactgcctcctttctaagtgccaaagtctgttttacaaggctgtaagtgaaatcactgacatggaaattatattttcaaaattaaaggaacaattttctaa

SEQ ID NO: 344600 - DNA, 260 bp, Homo sapiens
gggatagaatgaatgataacgttactaaaaggtacggggcccaccctgatgtaggctgggcctaaacaatgtcaccaagacttcccttctctttctgtttgtgcattggcttcacttaggcagattttctcttcagttgatcagctcaataacccagcgaacaaaaaccagcttctctttctcagtagtcacagaaaacccttataatttagtctcattggggtgactagagttatatttcatttccctttagtccagta

SEQ ID NO: 344601 - DNA, 304 bp, Homo sapiens
tccttgccaacacttgattttgtcagatttcaattttgttgctaatttaggtagacatgaaatgttatcttactattattttaatttatattcccctactgaaattcctattcaacctttttgcccattttcccattggttgtcttttttttttttttttttccctgagacaatgtctcactctggcactcaggctgcagtgcactggtgcgatctcggctcactgcaacctctgcctcccaggctcaagccatctttctacctcagcctcctgagtagctgggaccacaggtgcatgtcacca

SEQ ID NO: 344602 - DNA, 184 bp, Homo sapiens
tttgtcttacagcttttagaattgtgtacctttgagaggattttgaggggctgaattttattggggatcttttcattcctagatgtccataacttccaagacttccttccaagaagtgcagaaggacacaggcaatctatttaaccaaatgggtggtctatgcctctcttcacttattctttct

SEQ ID NO: 344603 - DNA, 200 bp, Homo sapiens
attcttttgagtaagggatgcttcatgaggcattttattaagtaatacctccgctttagctgctgcagagttctctacggttttgttatgttcaagccataaatgcattcaagataacagcaacttctctgatcttctaactagtgagactggcacctgctgactcgcaatgctccaataccatcccctttacctggctt

SEQ ID NO: 344604 - DNA, 638 bp, Homo sapiens
gtgcaaaatgagatcctgtctctaaaaaaatacataaataaataagccttaatgagcaggtggaagaaagtgcatgtaaatgtcaactaatgagaaaatgtaacaatgggattttacaatggccaattattacacctaaattatacagccaacaattatcttgtagtacaaggcttccactcatttccacactctgctgccatatgtatatgcatacttcaaaccctgcgaactcataggttcgcaggaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacgcagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatgggtgggttgtgaaaaccggtcaggaatgatatggcagagcagtcatgcc

SEQ ID NO: 344605 - DNA, 425 bp, Homo sapiens
gaaaactgaaattccagacccatggggacaaattattaaatctttcaaggctttgagagtggaaagaaaatgacctgtgagttttggaaaaagtgtaaggaatatatgttcagaaaataaattttcagcatattttagatgtttctcacaaaacactgttgaagctaaggagaccagcaactcttaacagtgttgatgcagtttttattactgtatgtcaagaaaaatatatcggaaaaggaactaaggtggtcaagagaacaatagacttgctgtctaggaacagaaagtaagttagttctggtctgaaaagaagctaggttaggtaacttaaatttattccttgccatagcagaaaagagatttaaggcacttcctggaagtggcacagctgaaaatatgaatagattcacatatatttagga

SEQ ID NO: 344606 - DNA, 630 bp, Homo sapiens
ctgtaatcccaacactttggaggaggctgaggtgggcagattttgagcccaagagttcaagaccagcctgggaaacatggcaagatcctgtctctacaaaaagtagaaaaattagctgagtgtggtagctggcacgtgcctgtagtccttcctacttgaagccaaggtgggaggatcaccagagcctgggaaggttgaggctgaaatgagctgtgatcatgccactctaccttgggtgacagagagacggtgtctcaaataaaaattaaaaagatcacttaagctatcttttatttagttttatacgttattcgaattatcttatgtctcctgagctttataaaagttagcactcaaattgacttttttttttttttgggccaggggatggggtcccactttgtcacccaggttggagtacagtggtatgatctcggctcactacaacctccacctcctggatgcaagccatcctgccacctcagcatacggagtagctgggactatgggcacgcgccaccacgcccagctaattttttttttgtatttttggtagagatggggtttctccatgttgccgaggctggtctccaactcctgggctcaggagatccacccgtatcagcctcc

SEQ ID NO: 344607 - DNA, 450 bp, Homo sapiens
tgagcagactatactcactgtctcctataattctcccagcagtcctaagagggtgtgttttccccgttgtacagtgaaggatggtgagccgatagcaggttccagggtcgcacaattcagaaatggcagagctgtgtcaaggcctgcctttaatgtggtgctccccacatgggaccaagccttcctccatgaggaaaggactcgcctgtgcctggttgccctggaaacagcatgttggtttctcctgtggctcctctcaagctggggagcatgaaactaagatacacagttctgagtatcaattggataaataggaaatcacctgccaagaagcctaaaaccaaagagtttgcctcttcctcctcccttccctttaaaagacatccacacaactccagccttataatatggagcatgtgaattaataaaataattgtgagttgttatctc

SEQ ID NO: 344608 - DNA, 1239 bp, Homo sapiens
ccctaactgtcccagtgtaatcttcagggccatcattctcctctctgaccacagtctccaatgctcccgattcctccatgccctctccaccgtgacacccattcttcaacctcatcaagcctccaggtcttgactcctccattttctcccaatctatcaatgcttcctggtttcagggccatcctaaccagtccagaccatggtgaggcatcatttaacctcgcctttgccaacacctcagttcccttgggctctcttctagtatttgtctcctagaagatccccaaccctcttccaatctcacctctcaaattttctccatctctgcacctgagcctcagggtaacactagagaaaatcaagtgatttgtaaattggtgcctgtgggaggcagaatggttgtcccctgagatgtccacatcctaatccctggaacctgtgaatatgtggccttacatgacaaaaaggactttgagagtgtgattaaattaagaatcttcagatgctcggattatcctggattatctgggtggccccagacagaaggacaaaggtccctctaagggaaagagggaggcaggagtgttggaggagggctctgacagagcagcagaggtcagagttctgggactgctggcttcaaagaaggaaggggccacaagctgaggaccactggcagcctctagagggtgagaaatctgaggggtctcccctggagcttccagaagaaacacagccctgccaacactttcatttttagttcagtaggacttaaaacctccagaactgatatgataataaatttgtattgtttaagccactaagtttgaggtaatttgttccaaaagcaagagccaatgaacacaatcccatgtgtatgcacggggctggtactatgctgcaccccagctatcatcctcaatgcccttgatatggtttggctgtgtccccactcaaatgtcatcttgaattgtagctcccataattcccatgtgtcgtgggagggaccaggtggagataattgaatcatgggggcagtttctcccatactgttctcctggtagtgaataagtctcatgagatctgatggttttatacatgggagttcccctgcacaagttctcttgcctgccaccacgtaagacgtcccttttctcttccttgtcttccaccatgattgtgaggctgccccagccgtgtggaactgtgagtccattaaatctctttcctttataaatt

SEQ ID NO: 344609 - DNA, 1054 bp, Homo sapiens
ggtctgtgttctgtcgcgactcacaactgaatcacagagtagggaggtgtcttagcgatgactcagttctcccctgcattgatgcatattaatgttattcctcactacccacagcccatctcatctggaggttttattcttcttgattgtctcagtgtcaaggagttcactgcctcatgaggcagctcaggaactgggctataaataatgactcattgttgtaacattgatttctctcctcactcctggaatctcagaagagtaaagggagaaatagggccagtgttgtacaattgattccctctttctttgtaaaggctgccaggtgacttgctaggaaagagaaacgggaggaaggggctaacatttagagtgaatgtttgcaacgggagaggcactttgttaggtgccttatatttgctgctgtttattttggtcttcacaaagttcttgtactcatgagtaaactaagtctcagggagatcaaaagccttatccagaatcacccaataaggaaggtggatttagaatttgggattttatcatcttagttcagttcattttaccatttctggggaacttgctatgtgccaggcactgtgttaaatacttcccacacatatttttgataatacttgaatcaatctggcattaatatacctatttgacaggtgaagaaatggaggcttacaaagtcaagtgactttcccagggtgaaaaaactagtacatggtatgaccaggattcaaatctagttgtgattgaacccaaatcctgtgtcttttcatagccccctgcagccccaggatttagcttccaaatactaagtatgacagcacattgggcatcagccacacacctggctctggcctaagctctgggatacaaggcgatggatgaggtataccatgccccctagtaatgagctaagtgttagttgctatgttgcagagcagggtcacattaactaatattttaagcagtaacgatacagtgctttgggcgttgacataaggaagagatggactggaagttgctagggtaagttgctagg

SEQ ID NO: 344610 - DNA, 966 bp, Homo sapiens
ggtctgtgttctgtcgcgactcacaactgaatcacagagtagggaggtgtcttagcgatgactcagttctcccctgcattgatgcatattaatgttattcctcactacccacagcccatctcatctggaggttttattcttcttgattgtctcagtgtcaaggagttcactgcctcatgaggcagctcaggaactgggctataaataatgactcattgttgtaacattgatttctctcctcactcctggaatctcagaagagtaaagggagaaatagggccagtgttgtacaattgattccctctttctttgtaaaggctgccaggtgacttgctaggaaagagaaacgggaggaaggggctaacatttagagtgaatgtttgcaacgggagaggcactttgttaggtgccttatatttgctgctgtttattttggtcttcacaaagttcttgtactcatgagtaaactaagtctcagggagatcaaaagccttatccagaatcacccaataaggaaggtggatttagaatttgggattttatcatcttagttcagttcattttaccatttctggggaacttgctatgtgccaggcactgtgttaaatacttcccacacatatttttgataatacttgaatcaatctggcattaatatacctatttgacaggtgaagaaatggaggcttacaaagtcaagtgactttcccagggtgaaaaaactagtacatggtatgaccaggattcaatcatgagagaaagggaatcctttccctagcttcttacacagagaatctgtaggacctgctggaatcactagttggttttgtttcccaagaggaaggttttctaaggcacacccctacatttttttttttttaaatcagcattcactgtaagaaaaaaaatcgacataatattctcataatgatttctcctaataaagatggatattgttacagttac

SEQ ID NO: 344611 - DNA, 1299 bp, Homo sapiens
caggaaaactgaagcccaaggaggtgaagtgattgcctaagttccttggatggaagttgaagaattcagattaaatgaaatgaagacactgagctctgcaagtacactgctttttgaatcccagaggggatgatgtagcaagaaggacctcaccagatgctggcaccttgatgttagacttcccagtctccacaatgtgaacttgcttgtcaaatgcctctttaaaaagcaagtgaagataattgcaagtcagctggaagtgctgccaagatatgacctccaggaaggcccagaagacaagtgatattgtgtggactgctacagcgcaatgtctaactgatgcaaaatgaagaatcaatttgaaattaagatgagtaaaggcatccagcacttacagcaaaaaacattgtcatcaggccctggggagatgaggacacctcccttcccttctcaggctccctttccctgtcagactctagctctcaaaggctgtcatcctccaagggtattccctacgtactgcatagcatctctgttaccctttgaattcaacagtattcatctcctccaacattcattcattcctttagtcaaaagtcagttgtcaaacacaaggcacaagtgcacatttaaggaattcatggccaatatttgtcatgtcatttcatgaattgtctgagaaacataaaacatacaatgaggatactgatccaagatacatggcacacaattaaattgcgaaaaacatgactctgagtccaaaagttcttattttttcacagtcttcagagtattgtatagaccccttgaaaaataaatttgcagagtgtgaatgttaattactgtcaccttcagaaaagagattttacacatttataaaagagaaatagtgactattctagattatagagcacagaaagaattctcaaactagtataaccctatttctctatatcacaaagacatcttgtaggcatgttcctctgaaggacttgagaattatgctttttttcctccttgtctctctaaaagcaaaaagcacagtaatctcgctgaagtataatcaaaacagagcctgatgtgaaaccagagccttgagttttcatcctgcatttgttacttaaaagctgacataagaaaaattatttaacttctcttaacctcagtttcttatctataaaatgggattataaaatgtatctcacaaggtagttatgaggattaaaggaaatgaaaaaatgcttatttggttttgaatcctggtttggtctagctatcaataaaactcattaagatgga

SEQ ID NO: 344612 - DNA, 1294 bp, Homo sapiens
ctagatcacatctgcattccctgcccaccttctccctccagcaacttccgcagcctagtcatacattgtgtgcatcaggccttcaccagcatgctaagacttgtccaagagtcttgatgtcctaaactgcaagtgacatgtaaagcttggatcccaaggtcaaacagcatgacttgaggataacataaatagtgaacttgcttgtcaaatgcctctttaaaaagcaagtgaagataattgcaagtcagctggaagtgctgccaagatatgacctccaggaaggcccagaagacaagtgatattgtgtggactgctacagcgcaatgtctaactgatgcaaaatgaagaatcaatttgaaattaagatgagtaaaggcatccagcacttacagcaaaaaacattgtcatcaggccctggggagatgaggacacctcccttcccttctcaggctccctttccctgtcagactctagctctcaaaggctgtcatcctccaagggtattccctacgtactgcatagcatctctgttaccctttgaattcaacagtattcatctcctccaacattcattcattcctttagtcaaaagtcagttgtcaaacacaaggcacaagtgcacatttaaggaattcatggccaatatttgtcatgtcatttcatgaattgtctgagaaacataaaacatacaatgaggatactgatccaagatacatggcacacaattaaattgcgaaaaacatgactctgagtccaaaagttcttattttttcacagtcttcagagtattgtatagaccccttgaaaaataaatttgcagagtgtgaatgttaattactgtcaccttcagaaaagagattttacacatttataaaagagaaatagtgactattctagattatagagcacagaaagaattctcaaactagtataaccctatttctctatatcacaaagacatcttgtaggcatgttcctctgaaggacttgagaattatgctttttttcctccttgtctctctaaaagcaaaaagcacagtaatctcgctgaagtataatcaaaacagagcctgatgtgaaaccagagccttgagttttcatcctgcatttgttacttaaaagctgacataagaaaaattatttaacttctcttaacctcagtttcttatctataaaatgggattataaaatgtatctcacaaggtagttatgaggattaaaggaaatgaaaaaatgcttatttggttttgaatcctggtttggtctagctatcaataaaactcattaagatgga

SEQ ID NO: 344613 - DNA, 1414 bp, Homo sapiens
cctgctctttacctctcttgccttgccaggggatgatgtagcaagaaggacctcaccagatgctggcaccttgatgttagacttcccagtctccacaatgtgtccttatctggctttggtgggaaggtaattctggccttttgaaatgagattggaagtatcctttcttcaattttctgaaaaagcgtgagaaggattggcattacttttttaaaaatgcttggcaatatgcacctctgaagccatctgttcttcggcttttgtttgttgagaagtttttgattattgcttcaatcttcttactggttattgtgaacttgcttgtcaaatgcctctttaaaaagcaagtgaagataattgcaagtcagctggaagtgctgccaagatatgacctccaggaaggcccagaagacaagtgatattgtgtggactgctacagcgcaatgtctaactgatgcaaaatgaagaatcaatttgaaattaagatgagtaaaggcatccagcacttacagcaaaaaacattgtcatcaggccctggggagatgaggacacctcccttcccttctcaggctccctttccctgtcagactctagctctcaaaggctgtcatcctccaagggtattccctacgtactgcatagcatctctgttaccctttgaattcaacagtattcatctcctccaacattcattcattcctttagtcaaaagtcagttgtcaaacacaaggcacaagtgcacatttaaggaattcatggccaatatttgtcatgtcatttcatgaattgtctgagaaacataaaacatacaatgaggatactgatccaagatacatggcacacaattaaattgcgaaaaacatgactctgagtccaaaagttcttattttttcacagtcttcagagtattgtatagaccccttgaaaaataaatttgcagagtgtgaatgttaattactgtcaccttcagaaaagagattttacacatttataaaagagaaatagtgactattctagattatagagcacagaaagaattctcaaactagtataaccctatttctctatatcacaaagacatcttgtaggcatgttcctctgaaggacttgagaattatgctttttttcctccttgtctctctaaaagcaaaaagcacagtaatctcgctgaagtataatcaaaacagagcctgatgtgaaaccagagccttgagttttcatcctgcatttgttacttaaaagctgacataagaaaaattatttaacttctcttaacctcagtttcttatctataaaatgggattataaaatgtatctcacaaggtagttatgaggattaaaggaaatgaaaaaatgcttatttggttttgaatcctggtttggtctagctatcaataaaactcattaagatgga

SEQ ID NO: 344614 - DNA, 1793 bp, Homo sapiens
ggaaaggagagacttttcaaaacctccatcctggggcacaccaacgtttagagatttggaagaggagagctgtcagaggacactgagaagtggcagtgacgttggaagaaaataagaatgctgtgtttctggagtcaagttaaaactccattttaaagatggagtggtcacctgtatcagatgtccccaggaggccaaggaaggaagcctcctatcagactctctgcctggcctgagatatccagttaacacctgcaattcagaataccctctcacccagcaataaagcatccagcctttgcatctgtaacaacctcctctgtaatttgtgcattctatgaatgctccaaatcataataaaatccatccattacttcagacagatgaaaacagttccttctaaaaagaggctaatgtttttaaaagacagtaagagaagaatgtcagctccccatggctgcagtagaaagtgctggatgagaggagcatctccagagcatggaagacaaagcagctttatcctcaacttttccacctcaatttccattttcctccaaggcaaaactcccactcctggcagattaaatgaaatgaagacactgagctctgcaagtacactgctttttgaatcccagagctatttcagcctggttaagaatcattgctggggaactagtgtggttgtttggagtgaacttgcttgtcaaatgcctctttaaaaagcaagtgaagataattgcaagtcagctggaagtgctgccaagatatgacctccaggaaggcccagaagacaagtgatattgtgtggactgctacagcgcaatgtctaactgatgcaaaatgaagaatcaatttgaaattaagatgagtaaaggcatccagcacttacagcaaaaaacattgtcatcaggccctggggagatgaggacacctcccttcccttctcaggctccctttccctgtcagactctagctctcaaaggctgtcatcctccaagggtattccctacgtactgcatagcatctctgttaccctttgaattcaacagtattcatctcctccaacattcattcattcctttagtcaaaagtcagttgtcaaacacaaggcacaagtgcacatttaaggaattcatggccaatatttgtcatgtcatttcatgaattgtctgagaaacataaaacatacaatgaggatactgatccaagatacatggcacacaattaaattgcgaaaaacatgactctgagtccaaaagttcttattttttcacagtcttcagagtattgtatagaccccttgaaaaataaatttgcagagtgtgaatgttaattactgtcaccttcagaaaagagattttacacatttataaaagagaaatagtgactattctagattatagagcacagaaagaattctcaaactagtataaccctatttctctatatcacaaagacatcttgtaggcatgttcctctgaaggacttgagaattatgctttttttcctccttgtctctctaaaagcaaaaagcacagtaatctcgctgaagtataatcaaaacagagcctgatgtgaaaccagagccttgagttttcatcctgcatttgttacttaaaagctgacataagaaaaattatttaacttctcttaacctcagtttcttatctataaaatgggattataaaatgtatctcacaaggtagttatgaggattaaaggaaatgaaaaaatgcttatttggttttgaatcctggtttggtctagctatcaataaaactcattaagatgga

SEQ ID NO: 344615 - DNA, 1739 bp, Homo sapiens
ggaaaggagagacttttcaaaacctccatcctggggcacaccaacgtttagagatttggaagaggagagctgtcagaggacactgagaagtggcagtgacgttggaagaaaataagaatgctgtgtttctggagtcaagttaaaactccattttaaagatggagtggtcacctgtatcagatgtccccaggaggccaaggaaggaagcctcctatcagactctctgcctggcctgagatatccagttaacacctgcaattcagaataccctctcacccagcaataaagcatccagcctttgcatctgtaacaacctcctctgtaatttgtgcattctatgaatgctccaaatcataataaaatccatccattacttcagacagatgaaaacagttccttctaaaaagaggctaatgtttttaaaagacagtaagagaagaatgtcagctccccatggctgcagtagaaagtgctggatgagaggagcatctccagagcatggaagacaaagcagctttatcctcaacttttccacctcaatttccattttcctccaaggcaaaactcccactcctggcagattaaatgaaatgaagacactgagctctgcaagtacactgctttttgaatcccagagtgaacttgcttgtcaaatgcctctttaaaaagcaagtgaagataattgcaagtcagctggaagtgctgccaagatatgacctccaggaaggcccagaagacaagtgatattgtgtggactgctacagcgcaatgtctaactgatgcaaaatgaagaatcaatttgaaattaagatgagtaaaggcatccagcacttacagcaaaaaacattgtcatcaggccctggggagatgaggacacctcccttcccttctcaggctccctttccctgtcagactctagctctcaaaggctgtcatcctccaagggtattccctacgtactgcatagcatctctgttaccctttgaattcaacagtattcatctcctccaacattcattcattcctttagtcaaaagtcagttgtcaaacacaaggcacaagtgcacatttaaggaattcatggccaatatttgtcatgtcatttcatgaattgtctgagaaacataaaacatacaatgaggatactgatccaagatacatggcacacaattaaattgcgaaaaacatgactctgagtccaaaagttcttattttttcacagtcttcagagtattgtatagaccccttgaaaaataaatttgcagagtgtgaatgttaattactgtcaccttcagaaaagagattttacacatttataaaagagaaatagtgactattctagattatagagcacagaaagaattctcaaactagtataaccctatttctctatatcacaaagacatcttgtaggcatgttcctctgaaggacttgagaattatgctttttttcctccttgtctctctaaaagcaaaaagcacagtaatctcgctgaagtataatcaaaacagagcctgatgtgaaaccagagccttgagttttcatcctgcatttgttacttaaaagctgacataagaaaaattatttaacttctcttaacctcagtttcttatctataaaatgggattataaaatgtatctcacaaggtagttatgaggattaaaggaaatgaaaaaatgcttatttggttttgaatcctggtttggtctagctatcaataaaactcattaagatgga

SEQ ID NO: 344616 - DNA, 1230 bp, Homo sapiens
tagggcttggagaatgtttgcaaccctttcatctttagcatgggtgctgttcacttcgcccttggaaatacttctctctctagatctggataggaaatggggcatcgtcttcccacagagacaagcagtgaacttgcttgtcaaatgcctctttaaaaagcaagtgaagataattgcaagtcagctggaagtgctgccaagatatgacctccaggaaggcccagaagacaagtgatattgtgtggactgctacagcgcaatgtctaactgatgcaaaatgaagaatcaatttgaaattaagatgagtaaaggcatccagcacttacagcaaaaaacattgtcatcaggccctggggagatgaggacacctcccttcccttctcaggctccctttccctgtcagactctagctctcaaaggctgtcatcctccaagggtattccctacgtactgcatagcatctctgttaccctttgaattcaacagtattcatctcctccaacattcattcattcctttagtcaaaagtcagttgtcaaacacaaggcacaagtgcacatttaaggaattcatggccaatatttgtcatgtcatttcatgaattgtctgagaaacataaaacatacaatgaggatactgatccaagatacatggcacacaattaaattgcgaaaaacatgactctgagtccaaaagttcttattttttcacagtcttcagagtattgtatagaccccttgaaaaataaatttgcagagtgtgaatgttaattactgtcaccttcagaaaagagattttacacatttataaaagagaaatagtgactattctagattatagagcacagaaagaattctcaaactagtataaccctatttctctatatcacaaagacatcttgtaggcatgttcctctgaaggacttgagaattatgctttttttcctccttgtctctctaaaagcaaaaagcacagtaatctcgctgaagtataatcaaaacagagcctgatgtgaaaccagagccttgagttttcatcctgcatttgttacttaaaagctgacataagaaaaattatttaacttctcttaacctcagtttcttatctataaaatgggattataaaatgtatctcacaaggtagttatgaggattaaaggaaatgaaaaaatgcttatttggttttgaatcctggtttggtctagctatcaataaaactcattaagatgga

SEQ ID NO: 344617 - DNA, 668 bp, Homo sapiens
ctaggtggctgatcactggaatacagtcatatccccaggcatacacacgagcctcacttgacgatcccaaagtttgtacatctgagcttgagacgtgacaagttgaggtctctgctttgttcttcatagttggcagtttgtctcctcgggtgcccctccggttagctgtttatcatacgtctagccctatcaacagtgcaggcagcttccagagtatagttttctctgcaaagtgcctggtggaggggtacctccttttccattgtcctaatggctccactgggcttccataccagccctttccagtgtcttaacagctcaaagaaacccatctgtggctttcttgttagcactggcctatcacaccttcctattgcctgttaactaaaattttgcctggaatgctttaagcttagagtactgggtctttgtttcacccgattgataggagagtgtcatgcagtcagccgaactccgacttctgtgctgtttaaatccttaggtaggtctggggcaaggcacaaaccactgtgtattcaaagggttatggtgcttgcattctgtgtgtatatgtttgtaatttccaaccagagtcgtttcccgtgcctgccctgcctctgtgcaatctagtctagtagggtagggaggcaagctgtggagtttgaaaa

SEQ ID NO: 344618 - DNA, 375 bp, Homo sapiens
gtctaggaaacacttgcttttattttcttgcctgaatatgtcagaaccttaaatcacccaatcaatctagaagtactacagttgattaaagtaagtcaccacaggtcacccattcgtggcaggtcagctaggtggctgatcactggaatacagtcatatccccaggcatacacacgagcctcacttgacgatcccaaagtttgtacatctgagcttgagacgtgacaagttgaggtctctgctttgttcttcatagttggcagtttgtctcctcgggtgcccctccggttagctgtttatcatacgtctagccctatcaacagtgcaggcagcttccagagtatagttttctctgcaaagtgcctggtggagggg

SEQ ID NO: 344619 - DNA, 374 bp, Homo sapiens
cagacagaaatgccgcctgtttcttcttttctgagcaatacactgttctagaaactggagcaaacagacactgcccctgctctcctggagcacatattctggtgggagagtgtgagaaagtaagcaaataagccaatccagtaacaaggtgactccagataaacatacttgctacctaattatgttactgaagaaattattaccatgaaagaaagaaggtgatgaaagggaaatattcttgggatggtccatctcatgagacaggcagagactcggttatttatctgactcccatactaaactgtaaattcatcaatgacaagaactatttcttaatatcctgcacaactgccttgtgaacgacaatcaatagc

SEQ ID NO: 344620 - DNA, 306 bp, Homo sapiens
aaatctgagcatatctcttgcttgcttacaatcattaaatgtcttcctgttgccaaaaataaagtttaaattctttaacaaaacctggaaaattatcgatacttgttgcactccccccacattgccctgcccatctttccagcatcgtctttcctcatgcttgtgtttcagccttttagttctccttggccatggggctttggcatactatgtatcatgacttaccctgtatgtagtcataaagtaacagtttttagctgtttccaccactaaaaattagttgattccttttcctcttgtttgttt

SEQ ID NO: 344621 - DNA, 240 bp, Homo sapiens
tgagaggtcagtggcccaagcccacctcaggaatcttcttaccaactctcagccatcaaggatatccaaggcgatgggggtggctgactccttgggagggggcatccaggaggccaaacggggtgggcggcaggcaggcggaaaggaggcgagcaggtagagggttattacgaaattgcttccataaaacctgtggctgttgtaaaactctgctttccaaagactttatttcctcctttc

SEQ ID NO: 344622 - DNA, 601 bp, Homo sapiens
gttctcacttacaagtaggagctaagctatgaggatgcaaaggaataagaatgacacaatgggctttggggactcagggggaaagggtgggaagtgggtgaggggtaaaagactacaaatagcatgcagtgtatactgcctgggtggtggatgcaccaaaatcttacaaatcaccactagagaatgtactcatataaccaaacaccacctgttccccaataacctgtggaaacaaaaaatttttttaaattaaaacttagaagaaaaaaaggatgtaacagaatgataggctggtggtaaaatctgtctaatcttgttcagtagaaggcataacttgtgactttgctttattgtgcttcatagatattgcattttttacaaattgaaggtttgtgccaactgtgttttgagtaagtctgttggcaccattttttcaagagcagatgctcactttatgtctctgtgtcatgttttggtaattctcacaatatttcaaactttttcattattgttatacctgttacagtgatctgtgatcagtgatctttgatgttactattgacttcatttgggggcattacaaaccacatccatataggat

SEQ ID NO: 344623 - DNA, 2063 bp, Homo sapiens
  misc_feature (346)..(346): n is a, c, g, or t
  misc_feature (728)..(728): n is a, c, g, or t
  misc_feature (1086)..(1086): n is a, c, g, or t
  misc_feature (1284)..(1284): n is a, c, g, or t
  misc_feature (1905)..(1905): n is a, c, g, or t
atgaagatcatggacttccgatacaaattacagcagcctgggcgacagaacaagactctgtctccaaaataaataaataaataaaatatttctcaaggattcagatttggggattttactgccaagtagcctggctttctcattattgattaacctacaaagaaaaatttgatatatctgatgaaaatcagttatattgtacctacaaaaacatctcttccatattacttgatgtattttaatgtcactgaatccattggtttatctttatctcttagaagctcttaaagtcacaggaattctagtccatatgatcagattaaccaaaaattcaggcagctactcngttcaaacaggaaagaaaaaactgaaaatgaattgttgtattgaatctgctttttcacaagagacaactaggcgtaatggttctgagcgtgggttagaaattgggcaagtcgcgttcacattcttttactaccttgaagagaagtctctgcctccatctcatctctagaaagatgggaataatatagcttgtgtcagcatgattgggggattgaaggagatgatgtctgtgaagagtttagcacagtgcctcctacatcagaagtgcttgacacgtgtctggctcttgcttctccaggaaggagaggaggggagaagagagagtttgcagggccgtagttattcaagtagttacagctatctcttctttctggtcacactgntgggtaatttgttcttgaaaagtgtctcaagatgactgctcccacttagtagctggaaaatcacatccttccagaaagggatctagagggcagacatgggtgaagtgtacattgttagagggctgactggaaataatcagtgcagagatcactgtgggcagagccacagccttcaggtcctataaagggcagaacgataggaataatctactgcataggaaaaccaaagaaaagaaggaggacgaaaaacactctggggaggaaaaaataattggggttcactactgggatatctttccctctgctagaagatccttcatacataatgaatcacagtttggaaatggagcctttgaanaaaaatccttacacaactggtaagagagaagtctcataccagccactgaatttttgcagaaatttgggcctccctccgcaagtgtactttcagactcaaattcctccagcatccaggacctcttgattaactatgtactctcaataaagagaaaaagatgagacctctgggaagcaagaattggtagaagctgggccnggtacagtggctcacacctgtcaccccagcactttgggaggccaaggtgggtggatcacttgaggccaggagtttgagaccagcctgggcaacatggcgaagcctatctctactaaaattacaaaaaaactagccaggtatggtggcgtacacctgtaatcccagctacagcaggaggctgaggcacgagaatcacttgaacccaggaggcggaggttacattgagccaagattgtgccactgcactccagcctgggtgacagagagagactctgtcttaaaaaaaaaaaaaaaaaaagatgctgaaatgtatcaaaaccagcctactcgtcatcctcttttaaaagaaaaagatgagtaaaccatcgcattactcattaggatgttaccagatatgtgagttggtcagagggactcctagctacaagtagaaggagtccactctaccattgactgtgtgcaaagtagcacattttatctacctttttaagatactcggccggatgcagtggctcacgcctgtaatcccagcactctggggggctgaggcaggcagatcacctgaggtcaggagttcaagaccatcctggccaacttagtgaaaccctgtctctgctaaanatacaaaaattagccagatgtcgtggcacgcacctgtagtcccagctacttgggagactgaggcctgagaatcgcttgaacctgggagatggagtttgcagtgagccaagatcatgtcactacactccagcctgggtaagagagtgagactctgtctt

SEQ ID NO: 344624 - DNA, 543 bp, Homo sapiens
tggactgcactggagtgattcctggataagacagttgggctttgagctgtcacatgacctcagttggccataggagaggtacagtctgtcccccattggggcaaactaagttaatgcttaattaccacttccaggcttttctaatcattcttgatcaagcctggatttgggggttctgggattctgtaagccttggtttaaaaaaattaattacatgttacgttataaaagacttttttaaagggtcaagcgaatctatttgtgaaaacacagaataagagtgactcccatgtgatgaataaagtggatatgagttgccagattgtaagtgagttaggtaatgacattggagaagtcataagtatctgagaataagtaataaagtgcatattttggaagcacttccaacaaatcaaccttgcttgaatctcatccatctgctagaactctcctacccaaccagcctcatcctgtggaatagtccctccctaatatctctcacatcctttatttccctggtctcctgccactattctagtccag

SEQ ID NO: 344625 - DNA, 182 bp, Homo sapiens
tgcccttggacatcagagctcttgatctcaggcctctggactctgaaaccagtgccccaatacccccttcccaggcctttggaccaggacagaattaccccactggctttcctggctcttcagtgtgcagacggcagattgtgaaacttcttagcctctataattgtgggagccaattccca

SEQ ID NO: 344626 - DNA, 838 bp, Homo sapiens
gggcaagccgggcaaggagaccccgcacccacacctacctcatttaagtgttggattttttgctgttttgaaatgtgagaccctctccaagccccctactgccccaaccctctcccccacctcactgccctcttctgagtgggtggaaggggggtaggaggaggaagaaaaacaacaacaaaaaatccatctttgtttttaattatgggcatgggatggtggttgaggcaaatgatgatgaagattggggatgactggcccctagttgctctaggacttccttctccatctggacatgggggcaggagggagctaaacctaggaccaggatatctccctcctgttttcccaacctcatcatgagcctgtttgccctccagcccctggacgggttgggtggggggtagggtgagggctatccctgagtggcatgcccatacctagtgaggcagggtgtggcccggagctcccactttccctcagtcaccaaactgctgctggtctggtgggaaggggtggtgatgtgggggtgggggagcttagtgtcagcgcggggagggtggggggtatttatctatttatacatgggattgtacatagtcttgtggggcatgggggagccggctggaggtgagaaccctcccctctccccccaccccccggggagagcaaatgtaaaactactaatttttgtgctttatatattctatataaatatatctattttctttttacaaaaccagtttataaatggtaggggggtgtggggcggacacatggagctccccttgtggggggggggcctccattacccgacctaccgcgccttttcctcacc

SEQ ID NO: 344627 - DNA, 662 bp, Homo sapiens
  misc_feature (537)..(537): n is a, c, g, or t
gggcaagccgggcaaggagaccccgcacccacacctacctcatttaagtgttggattttttgctgttttgaaatgtgagaccctctccaagccccctactgccccaaccctctcccccacctcactgccctcttctgagtgggtggaaggggggtaggaggaggaagaaaaacaacaacaaaaaatccatctttgtttttaattatgggcatgggatggtggttgaggcaaatgatgatgaagattggggatgactggcccctagttgctctaggacttccttctccatctggacatgggggcaggagggagctaaacctaggaccaggatatctccctcctgttttcccaacctcatcatgagcctgtttgccctccagcccctggacgggttgggtggagagcggaggggctcatttcttcagctcgccctcaccttgcagaaggggaactttaaccctggaagagcagtgttggacagcaggttccctccctgagatccacggactccaggagctgagtgagaggctgcagcanagggagcttggagatcgagttttatccccacattttgtagttgaaactcagacctggagaagttgaaaggactttcccaagatcacacggtaaataaattccttactaaccgatgtctgggggtg

SEQ ID NO: 344628 - DNA, 617 bp, Homo sapiens
gtggcctggctgtaaagagatgccttgcaggggccacctgagtcccataagattgtcaggaagaaatgatatcagtggccaggtcaaggagctatccattagtttctgaggatgtaatatttactaatatttacttggttttaggttttactgtacagttaattttttcttatagtttgtggtattttaacaggcaagcaggtgcttttaaggtggggggaaacatcttaactgtagcctgaaatcttgacttactgacagtgttgctagtagagtagtgtgtgatacccagaaaggaaaaaataaacctgttgagttcaacatgtttccccgaaatgagcaagaaacatatatcagactgcttaagagaatcccatttttatttgcattttgacactcttttattatttttatggtatacttttcctgtttcttcctttcaacctggaaattattagtttgtgtgccctttgggctttaaaataaagttcattttattctgtggtcatctcaagagctcttactcccccagttctcctggacttgttttggtgagagcctgttccaggatccctttcattgtaagaggacattgtatgggtggatatgatgacttt

SEQ ID NO: 344629 - DNA, 472 bp, Homo sapiens
tgagtgagatggaagaagaagcaaacctgaggctacagaaggatggctgaggttcaaattgtgcttttggaggggccctggggaaaagagaaatgagaaactagctctcaggtcttgtgcattttaggaccatcaggtctggaggtaccagaggtcctgggttggagaaataaaggatcccctatctgtagttcgaaatgtggggatgatctaccccacaaagtccccaagaccaggtttaatgtccaggtctagccctgttgcacccagactctggtgagtcacagggtccgtcctgcagaacaaggtgctagagaaggatctcctattgcagtctgtttccaacaagcagagcagaaagaaaaccatgcaagcactcaagagcctggtatttgagtccaggccctatcattctctagctatgtgttcttgggcagggcattgttaaacctccctgagcctcagcttcctc

SEQ ID NO: 344630 - DNA, 4407 bp, Homo sapiens
  misc_feature (767)..(767): n is a, c, g, or t
  misc_feature (2601)..(2601): n is a, c, g, or t
  misc_feature (2740)..(2740): n is a, c, g, or t
cacagcggacctacaggcgctcagagaagcccaccttccccctctctgtcccgagaaggcttagagtggtacctgcttgctcaagcaacctgctgcctccacccagagcagccgctcctctcctccctcccttccggaagatgctgaggatgacagcttttagcctgactcttacatttctttggcagagcagttagaggccagactgtcctgtgaaggcttctccttccttcttcctctgctcaggagaaaacttacaaacttttaaatgtaagaggcagatgagctgggaacctggaagtgggttgcatctgactctgaaagttcctccctctcgctggcattacctcatgctgccacaaagtgaacggatcactggggaaggcagagtctccccggcactgctgggaccctcccttgaagagcccccatgtcctgtaggcagagccttgtagtctgtccgcttggttactgactcgggctgtctgaccagcccctcttctgtgccttgtctgaggtccttgtccatctctgtgattgggcagcttctctctctggattgggtcacgtgaagcgggaaactgaagccattactctccaaaccctgtttcatcttcccaagcatgtcggaaagctggcaacagccgccacagacgcagccgcagcagccacagccaccgcagcctcagcaccatgcagagccaccgccagccctggcagagcacacgctgcctccgggcacggcggagaaccccctgggctgtgcngtctatggcatcctcctgcagccagaccccggcctgcagcccccacaacacgcacccctgcaggcagcaggagagccaggccccaaatgtggcgtgtgtggtcacgacctggcgcacctgtccagtccgcatgagcaccagtgtctggcgggccatgaccgctcattccagtgcacacagtgtctcaagatcttccaccaggccactgacctgctggagcaccagtgcgtgcaggctgagcagaagcccttcgtctgtggggtctgcaagatgggcttctcactactcacctcactggcacagcaccacagctcccacagtggcctggtgaagtgttccatctgtgaaaagacctacaagccagctgaggcagcggagccagccaccacagccgccccgtcgcttcccgcagcacccgcgccttccactgtcacccctgctgaacaggccgacaagccctacagctgccccatctgccaaaagcccttcaagcacctgtcggagctctctcggcatgagcggatccacaccggtgagaagccctacaagtgcacgctgtgtgacaaaagcttcagccagtcgtcgcacctggtgcaccacaagcgcacgcacagctccgagcggccctacaagtgcgcagtctgcgagaagaccttcaagcaccgctctcacctggtgcgccacatgtacgcgcactcgggcgagcaccacctgttccgctgcaacgtgtgcgagttgcatttcaaggagtcgtcggagctgctgcagcacccgtgcacgccaagtggggagcggcccttccgctgcggcgagtgccagaaggccttcaagcggccctcggacctgcggcagcatgagcgcacacacagcgccgagcggcccttcaagtgcgacctgtgccccatgggcttcaagcagcagtacgcactgatgcgccaccggcgcacacacaagaccgaggagcccttcaaatgcggcctatgtgagaagggctttgggcagcccagccacctgctctaccaccagcacgtgcacaccctcgagactctcttcaagtgccccgtgtgccagaaaggctttgaccaatctgccgagctgctgcggcacaagtgcctgcccggcgcggccgagcggcccttcaagtgccctgtgtgcaacaaggcctacaagcgcgcgtcggccctgcagaagcaccagctggcccactgtgcggcggcagagaagcccctgcgctgcacgctttgcgaacgccgcttcttctcctcttccgagttcgtgcagcaccgctgcgatccggcccgcgagaagccactcaagtgcccagactgcgagaaacgcttcaagtacgcgtcagacctgcagcggcaccggcgggtacacacaggcgagaagccctacaagtgccccaactgcgacaaggccttcaagcagcgggagcatctcaacaagcaccagggcgtgcacgcccgcgagcagcagttcaagtgtgtatggtgcggggagcgcttcctagacgtggccttgttgcaggagcacagcgcgcagcacagtgccgccgccgcggcagcggagggcgcctaccaggtagccgcctgcctgccctgactctgcggctgtggcccctaccagcctgacctgagtcggcgccgtgggcccagcaggcctcgcgcagcctagctcctcacagctgccttgcaccaagggccccacccagctcggtgttctgagacctcgggagtgaggacgcaggggtatgaggcagggagagggtgtgccgctcgtactcctggcaccagcgggcagtgcgggcggccagattgctgtggcccatccngattccacaaacctctttcccatgacaagattcactttcttgagagccatcagcaccccccttatttccggggcactggagccaggctggaagtcaagtggcttctccctgccctaaggagggtgtgatgccagcccanccttcccatatctttcaagctagcagccacataggttaggaaagcggaggctcatggtggggctggggccccagaggtgggctaggtgtaaggcatcagttgccgtgtgggggagaaggccagctttaagacgtaggcctggggactgggagggcagagggtgagtcacagccctctccgtctgctctagccaggggcgacgtgtccccaggtttctggcaggggagatgtgcagggtgggtcttggggctgggtctgcctggagaccagtgggcccagggggaagggggaagctgagaagttcgtgtgacaccctcagccaagggacagtgccatccttggggacaggaggaaaagcagcctgtctctgctaagggcaaatcctccggttttggaagcgcccctcccacctttgtagtgcagttcctaggtgtggtggggaatgtgccgtgctctcagcagacagaactgctggtgtgaaaggcagggattgtcagcccacctgaggctgggaggaagcaggaccaggcctaggatctccccagcagatgcaaacaagtgtcctcccctgaattgtgtgaaccaaagcgtcaggggcttggggcacagccccagtcagctcaacccagtcctgcttcagagccaagactaggccagggtggggacccccccagtaccctccctacatcaatgtggctgctggcctggaccccaggggtctggtacagccaagatgttctggacaacatccagctacttcaaaggccagagtgtcctttgggtcctcctagagtccccctaggtctctggctgcccatgaggctcatgaagcagagggtatcccagtcatagggagcagaaagagcaagtgggttaaggaagcctgtgggggacctggtggatggagttgaccaacatcgctgggtggctacggccctccttaggaagcccagaaggacctttattattaaaataatcattttgaaccctgctctatcccctgccctcttccagccccacccctccctggtcttgaaagaagactaatcagtgggcacaccaagggccctgaggggcagggagatgccaccatgcttctctgtcaccgtaagaaggctgaccagccacgcccacctcctctgtctgactgagttccttcctgtggccacagggaggggctggtccttccccttggtgctggctctctgtcacaatgcctcaaaagacatggaacccaggcctacaaccgtcccaactgctaattcttttcctttcattttgctttctgaaagcagtttgttatactattcataacattgtagagtttaatttcatgtcattttggatcttatataaaaatgtgaggatttggatttttaaaaagaatgactccattttaggtagccacttttgatgttaatatatagtgagtccaatgtatgctttagaagtaaagacattgaccgtcacagaccacaaaaaaaaaaaggggggggtctaaaattcctgggggccaagttaagcgtaccagttttgtaacaggggccatagggggatataaagaggcgggcgggtaaagggtgggggaaacgtcgggcttggagcctctttggggacacggcagatccgataggtcaggaaatagtatggagcttgcgggatgcggt

SEQ ID NO: 344631 - DNA, 4013 bp, Homo sapiens
  misc_feature (767)..(767): n is a, c, g, or t
  misc_feature (2601)..(2601): n is a, c, g, or t
  misc_feature (2740)..(2740): n is a, c, g, or t
cacagcggacctacaggcgctcagagaagcccaccttccccctctctgtcccgagaaggcttagagtggtacctgcttgctcaagcaacctgctgcctccacccagagcagccgctcctctcctccctcccttccggaagatgctgaggatgacagcttttagcctgactcttacatttctttggcagagcagttagaggccagactgtcctgtgaaggcttctccttccttcttcctctgctcaggagaaaacttacaaacttttaaatgtaagaggcagatgagctgggaacctggaagtgggttgcatctgactctgaaagttcctccctctcgctggcattacctcatgctgccacaaagtgaacggatcactggggaaggcagagtctccccggcactgctgggaccctcccttgaagagcccccatgtcctgtaggcagagccttgtagtctgtccgcttggttactgactcgggctgtctgaccagcccctcttctgtgccttgtctgaggtccttgtccatctctgtgattgggcagcttctctctctggattgggtcacgtgaagcgggaaactgaagccattactctccaaaccctgtttcatcttcccaagcatgtcggaaagctggcaacagccgccacagacgcagccgcagcagccacagccaccgcagcctcagcaccatgcagagccaccgccagccctggcagagcacacgctgcctccgggcacggcggagaaccccctgggctgtgcngtctatggcatcctcctgcagccagaccccggcctgcagcccccacaacacgcacccctgcaggcagcaggagagccaggccccaaatgtggcgtgtgtggtcacgacctggcgcacctgtccagtccgcatgagcaccagtgtctggcgggccatgaccgctcattccagtgcacacagtgtctcaagatcttccaccaggccactgacctgctggagcaccagtgcgtgcaggctgagcagaagcccttcgtctgtggggtctgcaagatgggcttctcactactcacctcactggcacagcaccacagctcccacagtggcctggtgaagtgttccatctgtgaaaagacctacaagccagctgaggcagcggagccagccaccacagccgccccgtcgcttcccgcagcacccgcgccttccactgtcacccctgctgaacaggccgacaagccctacagctgccccatctgccaaaagcccttcaagcacctgtcggagctctctcggcatgagcggatccacaccggtgagaagccctacaagtgcacgctgtgtgacaaaagcttcagccagtcgtcgcacctggtgcaccacaagcgcacgcacagctccgagcggccctacaagtgcgcagtctgcgagaagaccttcaagcaccgctctcacctggtgcgccacatgtacgcgcactcgggcgagcaccacctgttccgctgcaacgtgtgcgagttgcatttcaaggagtcgtcggagctgctgcagcacccgtgcacgccaagtggggagcggcccttccgctgcggcgagtgccagaaggccttcaagcggccctcggacctgcggcagcatgagcgcacacacagcgccgagcggcccttcaagtgcgacctgtgccccatgggcttcaagcagcagtacgcactgatgcgccaccggcgcacacacaagaccgaggagcccttcaaatgcggcctatgtgagaagggctttgggcagcccagccacctgctctaccaccagcacgtgcacaccctcgagactctcttcaagtgccccgtgtgccagaaaggctttgaccaatctgccgagctgctgcggcacaagtgcctgcccggcgcggccgagcggcccttcaagtgccctgtgtgcaacaaggcctacaagcgcgcgtcggccctgcagaagcaccagctggcccactgtgcggcggcagagaagcccctgcgctgcacgctttgcgaacgccgcttcttctcctcttccgagttcgtgcagcaccgctgcgatccggcccgcgagaagccactcaagtgcccagactgcgagaaacgcttcaagtacgcgtcagacctgcagcggcaccggcgggtacacacaggcgagaagccctacaagtgccccaactgcgacaaggccttcaagcagcgggagcatctcaacaagcaccagggcgtgcacgcccgcgagcagcagttcaagtgtgtatggtgcggggagcgcttcctagacgtggccttgttgcaggagcacagcgcgcagcacagtgccgccgccgcggcagcggagggcgcctaccaggtagccgcctgcctgccctgactctgcggctgtggcccctaccagcctgacctgagtcggcgccgtgggcccagcaggcctcgcgcagcctagctcctcacagctgccttgcaccaagggccccacccagctcggtgttctgagacctcgggagtgaggacgcaggggtatgaggcagggagagggtgtgccgctcgtactcctggcaccagcgggcagtgcgggcggccagattgctgtggcccatccngattccacaaacctctttcccatgacaagattcactttcttgagagccatcagcaccccccttatttccggggcactggagccaggctggaagtcaagtggcttctccctgccctaaggagggtgtgatgccagcccanccttcccatatctttcaagctagcagccacataggttaggaaagcggaggctcatggtggggctggggccccagaggtgggctaggtgtaaggcatcagttgccgtgtgggggagaaggccagctttaagacgtaggcctggggactgggagggcagagggtgagtcacagccctctccgtctgctctagccaggggcgacgtgtccccaggtttctggcaggggagatgtgcagggtgggtcttggggctgggtctgcctggagaccagtgggcccagggggaagggggaagctgagaagttcgtgtgacaccctcagccaagggacagtgccatccttggggacaggaggaaaagcagcctgtctctgctaagggcaaatcctccggttttggaagcgcccctcccacctttgtagtgcagttcctaggtgtggtggggaatgtgccgtgctctcagcagacagaactgctggtgtgaaaggcagggattgtcagcccacctgaggctgggaggaagcaggaccaggcctaggatctccccagcagatgcaaacaagtgtcctcccctgaattgtgtgaaccaaagcgtcaggggcttggggcacagccccagtcagctcaacccagtcctgcttcagagccaagaactaatcagtgggcacaccaagggccctgaggggcagggagatgccaccatgcttctctgtcaccgtaagaaggctgaccagccacgcccacctcctctgtctgactgagttccttcctgtggccacagggaggggctggtccttccccttggtgctggctctctgtcacaatgcctcaaaagacatggaacccaggcctacaaccgtcccaactgctaattcttttcctttcattttgctttctgaaagcagtttgttatactattcataacattgtagagtttaatttcatgtcattttggatcttatataaaaatgtgaggatttggatttttaaaaagaatgactccattttaggtagccacttttgatgttaatatatagtgagtccaatgtatgctttagaagtaaagacattgaccgtcacagaccacaaaaaaaaaaaggggggggtctaaaattcctgggggccaagttaagcgtaccagttttgtaacaggggccatagggggatataaagaggcgggcgggtaaagggtgggggaaacgtcgggcttggagcctctttggggacacggcagatccgataggtcaggaaatagtatggagcttgcgggatgcggt

SEQ ID NO: 344632 - DNA, 554 bp, Homo sapiens
tagctttataagttctaaaatagtatttagaagtgtgaagtgtgactggcacaaagttatagtctccctagggggcttgtctgaagggctgaacttgtctgatacttcttattctgcacgtgcttacgggtgtgtctggaagaagtaggttaatctcaatactttatagttgttcttcctatagtttaatttataaaataaatgagcccaatttttcttgcttcattgaggaaaaatgtttatatgcatagaggaagaagggaaataaaaaactagcccaatagagaccagctaaatctgttgtttttctagtttacaacttccataggatggggaaggcttataggtttattttgaaaaggacttgagcttaagtcctatggctggagagtaaaaatagatgatgataatgtttagcaattaattagcagagtagatgattttgtgattaaagaaagttaaaatgttactccagattaactgttaactagaaaacttttgcagttttgtggttttatgtaacatctcttcaattaaagatgatcttaagcact

SEQ ID NO: 344633 - DNA, 542 bp, Homo sapiens
aggaattttggaaatcttgtagccctcccgacttatttttcagtaaaaactgaagcctagaaatgtagcttttgcctaggtcacattggaaccaaaccctataactccagatttttttgctattttttttactgccttaaaaattttattttatttatttatttttttgagactcggtttcactgtgtcacccagggtggagtgcagtggcaccatcatggctcactgtagctcctatctcttgggtcaagccatcctctcaccttagcctcctgagtagctgggaccataagcacgtgccaccatgcctggctaatttttatttatttattatagaaatagggtttccttatgttgcccaggctggtctcgaacttctggcctcaaccaatccccctaccttggcttccaaaagttctgggattacttttgagtacattgcttttgagatggaaagctaggtggtatctccacttaacatgagaattgaggtaagatatcgagtcatccatatgatgttagattgatgttagattatgacg

SEQ ID NO: 344634 - DNA, 2572 bp, Homo sapiens
  misc_feature (5)..(6): n is a, c, g, or t
ggagnngcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggcgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccatcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatg

SEQ ID NO: 344635 - DNA, 2522 bp, Homo sapiens
  misc_feature (5)..(6): n is a, c, g, or t
ggagnngcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggcgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccatcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaat

SEQ ID NO: 344636 - DNA, 2587 bp, Homo sapiens
  misc_feature (5)..(6): n is a, c, g, or t
ggagnngcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggcgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccatcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaagcatcttgggattgaatttatggaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatg

SEQ ID NO: 344637 - DNA, 2181 bp, Homo sapiens
  misc_feature (5)..(6): n is a, c, g, or t
ggagnngcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggcgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccatcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaagacataaccttatagctgagctaaggagaaacaaggcacacagatccaaatgcatgcagatccagctatcagcaactcatcttagatcttcttccattccccatttgggcttcattctctaagaccccttggcctttaggaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcgcccacgcgtccgcggacgcgtgg

SEQ ID NO: 344638 - DNA, 371 bp, Homo sapiens
tgcagcacatggagtttccagctctggccatgggctcagacccactcggggtctcagtgtcctcagttgtaacattagagagatggcatcaatgcttgataaggacccttctataattccaattgccagttatccaaactctgattcggtggtcgagctggcctcgtgttcttatctgctaaccctgtcttaccttccagcctcaacataaccttatagctgagctaaggagaaacaaggcacacagatccaaatgcatgcagatccagctatcagcaactcatcttagatcttcttccattccccatttgggcttcattctctaagaccccttggcctttaggaaggtatagtatttaagtaatacttct

SEQ ID NO: 344639 - DNA, 1538 bp, Homo sapiens
  misc_feature (5)..(6): n is a, c, g, or t
ggagnngcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggcgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccatcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatgtgggtgtgggggaacctttaaaaaagagggggtttgtttttccttcccttttttcccaaaaaaaggggggttttaaaaaaaaaaaaaagggggggggaggggccccggtttttttcgcggtttttatttttaagtggggggcccccctttgtgtggccccctcccccggccggtgaattatgttttaaaaagggggccttttaagaggggttccccttttttttttgga

SEQ ID NO: 344640 - DNA, 1772 bp, Homo sapiens
  misc_feature (5)..(6): n is a, c, g, or t
ggagnngcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggcgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccatcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaacc

SEQ ID NO: 344641 - DNA, 3030 bp, Homo sapiens
ggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaagcatcttgggattgaatttatggaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttc

SEQ ID NO: 344642 - DNA, 2026 bp, Homo sapiens
tgcccttatacctcttcgcctttctgtggttccatccacttcttccccctcctcctcccataaacaactctcctacccctgcacccccaataaataaataaaaggaggagggcaaggggggaggaggaggagtggtgctgcgaggggaaggaaaagggaggcagcgcgagaagagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcgccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaacc

SEQ ID NO: 344643 - DNA, 487 bp, Homo sapiens
ccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctga

SEQ ID NO: 344644 - DNA, 449 bp, Homo sapiens
caaagccatcatatggaaaactgagatgaataaaacatcggatttcattttaaggggttccctttgaaagaaggcaaccacttaaagtgctgggatctttccaccataccaacttaagaactgcattctgtccaaatttttaaccatttgggggaagtgccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactacgtaatggccagcttctacagtacgtccactccctttctgtctctgcctgaataggagcatgctcagttggtgctgctttcttgttgctgc

SEQ ID NO: 344645 - DNA, 1704 bp, Homo sapiens
  misc_feature (5)..(6): n is a, c, g, or t
ggagnngcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggcgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccatcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaacc

SEQ ID NO: 344646 - DNA, 2100 bp, Homo sapiens
ggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaacc

SEQ ID NO: 344647 - DNA, 1975 bp, Homo sapiens
tgcccttatacctcttcgcctttctgtggttccatccacttcttccccctcctcctcccataaacaactctcctacccctgcacccccaataaataaataaaaggaggagggcaaggggggaggaggaggagtggtgctgcgaggggaaggaaaagggaggcagcgcgagaagagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcgccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaacc

SEQ ID NO: 344648 - DNA, 1682 bp, Homo sapiens
  misc_feature (5)..(6): n is a, c, g, or t
ggagnngcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggcgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccatcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgattgattgttgctttttttccaattttgttgcatcatgttgaataatgctgttttatatgtagagtcttttaaaacattcacaccattcgtcatcactcctctgtcatatgcagttttgttttttgctcttttcaatgtgtgtgaggtgttttttgtttttgtttttgtttttttgccatgttatttatagtgttgctttccttgtgctttccttgtggttttcttggttggttattcagaaaagatgtgcagatatcacagaggcctatagccttttggtatctacttctacatccaatgtatgaattaagctgtaagataatgttgctttcttatcccagtgatcacctgccaaatgaataagacaacaaagagaagcagaagggcaagaagattatttactgacatatatctattacacttgggattgtgcttactgttgcataactattttttaaacggagtttagttttatattgctagt

SEQ ID NO: 344649 - DNA, 2625 bp, Homo sapiens
  misc_feature (5)..(6): n is a, c, g, or t
ggagnngcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggcgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccatcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaagcatcttgggattgaatttatggaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttc

SEQ ID NO: 344650 - DNA, 1970 bp, Homo sapiens
ggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaacc

SEQ ID NO: 344651 - DNA, 1844 bp, Homo sapiens
ggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttc

SEQ ID NO: 344652 - DNA, 1036 bp, Homo sapiens
gggcgacagagcgagactccatctcaaaatacaaacaaacaaacaaaaaagaaagaagaatgatctcaaataaatgacccaatcttccaccttaagaactagaaaaagaagaatgaactaaacccaaagcaaacagggaaggaaataataaagattagagtggtgataaacagaacgggaaatagaaatacaacagagagaatcaatgaaaccgaaaccagtttttcaaagtgatcaacaaaattgacaaacttttagctagactattaaaaaaaagagagatgactcaaataactaaaatcaggattgaaagtgtgagctttacaatgatcttacagaaataaggattataagaaaatagtataagcaattgtatgccgaacaaattagacaacatagttgaaatgtgcaaatttttagaaacacataatttgccaaaactgaataaaaaggaaatatttggatagagtgataacaagtaaagatattgaattaataatgaaaaaacctccaaccacaaaaaacccagcaccagatggcttcaatggtgaattctaccaaatgtttaaagaattaagagcaatctttctcaaattattccaaaaaattgaggaggggagaatactgtctaattaattctatgaggtccatattactctgataccaaagccaaatacagtacaagaaaattgtagaccaacatcccttatgaatacagatgcaaaaatcctcaacaaaatgttagcaaacaaaatctagtggccaggtgtggttacgcacgcctgtaatcccagcactttggaaggctgaggtggttggatcacctgaggtcaggagttcatgaccagcctgactaacatggtgaatccccatctctattaaatacaaaaaaattagccaggcatggtggtgcatgcctgtaatccgagctacttgggaggctgagagaggagaatcacttgtacctgggaggcagaggtttcactgagccaagatcgcgccattgcactccagcctgggcaacaagagcaaaact

SEQ ID NO: 344653 - DNA, 468 bp, Homo sapiens
ccagtgtcttcctttttggcctcatctacattatttaaaagagttttctattttcataattgcttttatgccaaaaataagttttatgcaaacaaagattttgtgatgatgccaaaatttggcattcaggttgaaaatagatacagcttatgagtcaaatacacttttggagaatagggaatctgatgtatatagtaaaaagtaaatgataatatcagttcattggatttccactataactcgtaagtttcatgaagctattaaaaaactcttcttaaatcctgcttttacagtttcataattacatacctcaaactaggtttactcattttcagatatagattatgtttgcagaatgaatacatgattaattatggtatacctctttaatccttcatttctggtgtgggtgttttcacagcactcagataagtgattggttgaacatggtcaaacagtctaacccct

SEQ ID NO: 344654 - DNA, 352 bp, Homo sapiens
agacagagttttggtggcctatggcctgatgtcctcactgtgggtcatgggggcttggtgctgggtggcgagggagaagtcaaacaggccttttgattagccgagcatggtggcgcatgcctgtaatcccagctactcaggaggctgaggcaggaaaattgcgtgaacccgggaggcggaggttgcagtgagccgagatcgccccactgcactctagcttggcaacagagcgagactccgtctcagaaaaaaaaaaaaaagggccttttgtcaatcatcattctcttgtttcaggggtttggtgtatctaatctcccagacatcaatgatacctaaagtcttctttctacgg

SEQ ID NO: 344655 - DNA, 616 bp, Homo sapiens
attttaaccccaattcttttgctgctcttgtacttgaggaggtggattggttctctgagctctgggaagcagccatggagatgggggttctgttttttatgggctacatgttgattccttctgagaagaggatgcctaagaaggacattattgctccttctaccaaaagctgccccctgcttgtttgtctgtgaccatcttcagaacatccttattttggagtggatcaagagaattgagggaaattttgagctctctacacagattaaagggagtgtgccactaagaaattcctccagatggaaaaatagaaatctttactcctgcacacatcagaacaagactagggaggacatcagtggaaagaagcgacaaaactgtgagaggcctttgaaaacttaattacagtctctaggttttcttatctgtaaaacgggaataataacctgcttatatattagttatggaagaaaaaatgagataacatgtgctgatcatagtgtctggcgtttatagtttggagtattacatagaaaatatttgttttggaataggatatagaaaatataaattatatttagcttcacttaactttcaactgtaattcagtttgatt

SEQ ID NO: 344656 - DNA, 392 bp, Homo sapiens
agatgggtggacagacaaaggaataaataaagtggacccactggacagagaagactttggttcaaaaggctcataaggtgccccaggcaccctaacccccaaccaggtgtaccccataagattacaggattgccttccgattgtccctccctgatagggatgaaaattctgccaaaatgtcttccttgggtaatgtttgttcaggagttaattgggcaattcagagactccaatcgggaaacacagggcctgctgccagatgaccttgagagaagcaagagccaagtccctggaccctgatcataacctcttcctgagaaactcactgagtgcaggtaaggaagagggcatgcctggtcctggacactgtatgcctccatcctgctcaataa

SEQ ID NO: 344657 - DNA, 312 bp, Homo sapiens
tgaaatattgcctttgaggaatttttatactagttgaaagataagtcaaatatgcaaatagctatagctaggacagatgaagtgcaataaaagaaatacttcctttgcactggaagttcaaagaaacaaaacagaaaacatagtgaagtgatcaggtaagaggtggttttgggttgtctttgctgatgttcttctctaattttttaaaatttttattattatgggcatatcagagttatgtatatttacaggaaacattatgttttgataagtgcacacaatgtgtaatgatcaaattagggtagttagaat

SEQ ID NO: 344658 - DNA, 364 bp, Homo sapiens
gctctgagaatctacagactcgaatggtggagacaggtcctcgagggcagcttcagccctggggaaagaaacagaaaaggggggctcaagtctctgcggctgaacacacatacacacacacacaccccccccacacacacacaccacacacacacacacacacacacacacacacacacacacacacacaccagctctgggcccagctgtgactctttgcagccacaggcaagtctgttgacttctctgtgtttcttggtctactcatatgaaatggggatcagttctacttgctgtatttatgtcacaggaatgaaatttacatggaagagaggtcaaagtattatttaagcacaaaccaatg

SEQ ID NO: 344659 - DNA, 600 bp, Homo sapiens
ggttgagggtgatagaggttcccaatgtgagagggctggcaggatcttaccaggggtgaaggtcacccagaccacgaggtagcaggcggggtctcaaggactcccctggaccagcgctgctccctccccattacccactaacttgtgggccctgagctgatgccccacgcaaagatactgtgcccgaggggctccaccaccctggtgccccgctgctgcctccaggagctgcccgaatccatcgtcctctgctccatgccagcccaccctgcatgaggccccttcctccaagtgaccatgcatgggacgctcatttctcactctgagctagacaggttggtggggggagtcttagctctctgaagcccacccaaaacccccgactaagcacccaagtgagcatgtgagctcctgagggctggggtagcatgtcccttgtttggaacccccacgtcctcagccattgcagctcccactcaggatgctggtttttcagttctcagttcacacctgctctggagcagggctgggagaaagacacggccttcctgcctcagcggcactcccgagcaacacgtgccgagcagggacccacagggt

SEQ ID NO: 344660 - DNA, 602 bp, Homo sapiens
tgggcacaccatcccccagagtgcctgatattggtgaccttgctgcatggcggatgctaatgggtattgactgaagggacaaggtgccttctccacccatgcttggtcattagcacatggttaggtgggcacgcgtggcctcctcttccacctctcttttggccattttccttgccctctcccccaccccctgacctctggcagcccagagctcccctcagcagtgctcacccaactccctcagggcctgaatttccagggtgagagtcccctctctacaccgtctcagtgggtgcttctgccagggtgggatctcgccagggattatgcttgcatcttaacaggaatttactggggatggaagtattaacccaaatggagttaccacagaggggatttcacatgtttctcaaataatgccagagtgagccaaggtttacataaccagtacgaggtgaggggggtgggaagagggcaagcatttccttgcgaggctcctggcagctttatttctgacttgcgagtggttcaagaagcctccatcctcccacgcatggagaagaccagcattgactgcagccccgctatgtccccgcgctggc

SEQ ID NO: 344661 - DNA, 377 bp, Homo sapiens
tatccccatggcccactcctgtcccctcttcttagagcctgcagtcctgcagactgcctccacccgtgacatgtgacatgtgagcctgctgcctcccctcttcatcccctacccctcccctgactaattaggccaacatgcaacttccagggcctggcagatgaggagccaagaatgccatggacaggggccaagtgtttttgttgacattgctcaagtatagctttgtggagcggcctctttgctgtagcagagaaatccaaggaagctggagaggtgagcgaggggagagcagggaggatagccagtgtgggcgcctctccgtatccccttcaccttcccaccctccaagccttcccagctgcccaccctctgcc

SEQ ID NO: 344662 - DNA, 399 bp, Homo sapiens
atgaattaaacagactactggaatttcactgcatcccatatccaaatgtgtactacagtcatctgtacatattttaatcaagaaatggtcaaagttgcatttgctaatgaatctgtgttaaactacaagtgtgtcatccttataagcatcatttgtagtatggattttaaataataataatggttgagcccaaatgactctgtgaggaactataatagagacatagtacataaaagaaaaagagaaggaaagcgaccacaactgaggagagaagcaatggggaagaagtagagggtcagggtaggaagagtgctggcctggaagctcccagccactagctgtgtcctcaggcaagtccttccaacccttgggtctttattgcttacatcacaagagtag

SEQ ID NO: 344663 - DNA, 742 bp, Homo sapiens
  misc_feature (247)..(247): n is a, c, g, or t
cagcgggcctctgcgtgggcggcgggaatccgcggacatcgggtcgggtctaggctcccgagtccgcgctcctgggcgggagcccttgtctgggtctcgcggggggctgccagatgcgtaggccacactgactagttccttcttgtcgcttttcccagcaaatggcggatgacgccggtgcagcgggggggcccgggggccctggtggccctgggatggggaaccgcggtggcttccgcggaggggnctttttccccgggggccccgggggggaaaaggcgggcttttttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttccttttttttcccccctttgggggggcggggggggggggcccccccttttccttccgtgccaaagggggaatttgcaggtttcttgaagattatgccagtgcagaagcagacccgtgccggccagcgcaccaggttcaaggcattgtttgccttaaattccgggggcggaacctttaaaccaaaaaattttgggggccccaaaacgggttccggggttcctggggggtggtttaaaagtggcgtccca

SEQ ID NO: 344664 - DNA, 179 bp, Homo sapiens
  misc_feature (6)..(7): n is a, c, g, or t
gggggnntttttgtggaatattccccccccaaagttcccccctaccagggaggttcccctgccccatctcgtcaagacccacaccagagtctccgtgcagcggactcaggctccagctgtggctacaacatagggtttttatacaagaaaaataaagtgaattaagcgtgaaaaaaaaa

SEQ ID NO: 344665 - DNA, 1089 bp, Homo sapiens
cagcgggcctctgcgtgggcggcgggaatccgcggacatcgggtcgggtctaggctcccgagtccgcgctcctgggcgggagcccttgtctgggtctcgcggggggctgccagatgcgtaggccacactgactagttccttcttgtcgcttttcccagcaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcgtttgttgctatcggggactacaatggccacgtcggtttgggtgttaagtgctccaaggaggtggccaccgccatctgtggggccatcatcctggccaagctctccattgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttttaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgaaaaaaaaa

SEQ ID NO: 344666 - DNA, 426 bp, Homo sapiens
caaagactacaagacttcagagtcacagctggctacaaacccaccccctgcacccagtaccactagctggagacactggaagatgctcttgttattctcggatcaccgcctacccccaaaacccatcctccctgctgccttacctgagaagttgaaccccagagacagaaaggatcacctgcactccttgtactgggccttcccatcggccaacgtgtggcatgaacgaggctgcatccctcttccatagcacctgcactcgtaggctctgcaaatttcatccccacctttggcccttcaggcctagggcaagtcacagctccccagaactgttcatccccaggtgtctcgccatccctagatagcacctgtaagcctgactacacctctgtaaagcgtgcccttcattaaattttcttctgttaa

SEQ ID NO: 344667 - DNA, 287 bp, Homo sapiens
tgagactctgtttcaaaaaaaaaaaaaaatgcaggatgtgttttctcttttttaaatttaatcagggtatgtgtttcacacagctcccctgctggacccagtggcagtcatttctaagcaatcttggggttccttgttattgagcatggaggtaaacctcatgcctcttacttcagctgtccaggccctcaattcttaaagtatcatccaagcaacattggcatttgcagggagtttgttacaaaatgcagattctcaggccccaccccagatctaccaaattagac

SEQ ID NO: 344668 - DNA, 689 bp, Homo sapiens
ctccagtatttatcacttctttgtgttgggaatatttcaagccttctcttttaacatttattttattttattttaagttctggggtacatgtgcagaatgtgcaggtttgttacataagtaaacatatgccatggtggtctgctgcacctaccaacccatcacctaggtattaagtccggcatgcattaggtatttttcctgatgttctccccactcgtgtatgtctttattagcatcatcagaatgaactaatacatatgttcaacagaagatgtctatgaaatagcttaaatgatacaaaagagcatacactgaaaaatattcctttttttttctttgagacagtttcactctgtcacccaggctggagtgcagtggtgcgatcttggctcaatgcaacctctgcctcccacgtttaagcaattctcctgcctcagccgcccaaatagctgggtttcagttacgtgccaccacacccagataatttttgtatttttggtagagatgaggtttcaccatgttggccggactggtattgaactcctgacctcaagtgatctgcccgcttcggtctcccaaagtgctgggactaggctgggcgcagtggctcacgcctgcaccacggcttctgagcctttgatggactgttctctgctaatgttttaattcagtctccggtcccctcttt

SEQ ID NO: 344669 - DNA, 614 bp, Homo sapiens
gggcaagtgggggcgtgggggtttccactagagggagggaagtttctgtttcccatgtgttagttgtagttgtctttgtgcttcaccagaaaagaggtagagtgcgcaccttcacactaagagcccgaaattgtggtcagtaccataccaggaacgactgtctggccttggcatctatcagattcgaatcagttctaacacagccctacccaactctttgaaggtttctctctctatctagtgtgagaccactgttgagcttatctctggtttggtggcttggtcaccccactgtggggcccatacagaagtagttcactcaataccttgttagtaagttgcagactcatctggtcactggcaaagaacaacatcagaaaaaaaaaaaaaaatcgccaccatttaataataggcggtggggggcggaggcgggtatggtgttgacaatgtaaaagaagtatactaatgccttctctgtttggtcctttaagaggagctgttcagctcagaacacaccctgcacatcctgccaaggcacaaagtgacaaggccatctaacctacaagaagcaaaaaatgatggtatgttttcaaggatcacaggttaatataagc

SEQ ID NO: 344670 - DNA, 595 bp, Homo sapiens
gtgtgtagctctatgtaagtgtatgtaactgtaattgtatgtgtgtgtaggtgtatgtaggtgtaagtgtatataggtgtgtatgtaggtgtgtgtaggtgtaagtgtatgaaagtgtgtgtaggtgtacctacatatgtgtaggtatacctaggggtgtgtaggtgtatttaggtgtgtgggtgtgtgtttaggtgtgtgtagatataagtaagcgtaagtgtgtgtaggtgtatgtagctgtaagtggtgtgtgtgtagttgtatgtaggtgtatgtgtatataagtgtatagtatacgtaggtgtgtatatgtatgtgtatgtaggtgtaagtgtatgtacatgtaggtgtctgtatgtgggtgtatgtactgtaggtgggtatgtgtgtatgtaggtgtgtgtaagtgtatgtatatgtaggtgtctgtatgtatgtgtatgcaggtgtatgtactgtatccaggtgtgtatgtgtgtatgtaggggtgtgtgtgtgtgtgtaagtgtatgtatatgtacattcacacacacataccctaactctgtccactgaaagggcctgggagccataacaccccaaaagcaacaag

SEQ ID NO: 344671 - DNA, 210 bp, Homo sapiens
cactaccatcctttgctactccacaaacagtgccgccagttactgtgttatatggtgtgtgtagatataagtaagcgtaagtgtgtgtaggtgtatgtagctgtaagtggtgtgtgtgtagttgtatgtaggtgtatgtgtatataagtgtatagtatacgtaggtgtgtatatgtatgtgtatgtaggtgtaagtgtatgtacatgtag

SEQ ID NO: 344672 - DNA, 335 bp, Homo sapiens
ggtgagccaccgttgaatgacattcttgagaatggcctcaaggcgagctaactaactcttgtcatatttgggttacattttgttttgctgttttctcttagagacagcgtctcactctgttgcccaggctggagtgcagtggcgcgatcatcactcactgcagcctcaaactcctgggctcaagtgagcctcccacctcagccttccgagtagctgggactacaagtgtgcaccatcatgcctaatttttttttttttttttgagacggaatcttgccctgttgcctaggctgtactgcagtggtgcgatctcggttcaccacaacctccgcctc

SEQ ID NO: 344673 - DNA, 723 bp, Homo sapiens
tttagctttgcaatgtaaaatttaccatatcagccctccctgacctcagtagagccaattttgcttaagagtagtcaattatatgcatctgtgatcatcccttgtcatagatgcaataaggagaagcatcagcatatactggaatatactttagactttataagtacatgtgcatatcacagcatatagcatatgaatatagtattcctctgtgtatcctaaacaacagacatatacttagtaatagaaataatagcaaatggttacacttttcaaaataacctactccatccaatacaaacattcttggtgttcagtattaatggtcacattttgtacatgtgcaataatccttttcaagcaaaaggccaacctttgttgaaacagaccaaacattatgaatcatgaataagaggatatttaatgatctgtggcatggtttgattaatggacttacctttaataaggaagcagtttattaaatttcttctggaatgatgacatttcccaaaatcagctttaaatataaaatttaattctttgagaaatatgaatgcttggccaggagcagtggtttatgcctgtaatcccagcactttgggaggcagaggcgggctgatcatgaggtcaagagatcaagaccatcctggccaacatagtgaagtcccgtctctactaaaaatacaaaaattagctgggtgtggtggcacgtgcctgtaatcc

SEQ ID NO: 344674 - DNA, 378 bp, Homo sapiens
agtgtgcaataattaaactttaatgtgaatttccaaatgacctacacttggtttatgaactgcctataaatatggagatattttctattaaagaaaacatgaaatatcagttcacatgcctaaaaaggaacagtagttttgcatctcacataatagccctttttctataaataccaaagtatgtatggagtgtttggaaagcatttaatactatgttgaacatgaaattatttttaaatcaggcatttgaccctttaaaaaaatctcaaaatgtcagaacctgacttataatgtttatgatattgtttttaaattaaattagcaaaaactgagaagactttagggaaattttatattgatttttaaatatataaattc

SEQ ID NO: 344675 - DNA, 533 bp, Homo sapiens
tccgtctcaaaaaaagaaaaaaaaaaaaaaagaatgagaaaaccacaggatatacacacaaaaagcatttccccctcattacttctgcctccacaaagatggttttgttttgtttttttatttttcaacatgaactgttctactacaggagaggtttttctatttatctaaattgatcactataaagaaagaagatttgggaagtatagacatggacccaaaaaatcacaaattctaaagaagtttattttaaaattaatttcagagagctcatcctccagaacgcttagaccattctatgtgtctgagcttactcaacaaaaaaataagagccgggcagggttgatataaaaacaagtactgagaagctataggaactgttttatgggcaggatcaagagacttgtttgtgtatctaataattaagtcaaaattaaagagtgaaacatatgagcacatacttcttttacgagatgtagacagagaactatttagagatgcaaacaaaataaagttgacctaaaaaatcagaa

SEQ ID NO: 344676 - DNA, 416 bp, Homo sapiens
ctggaagggagtagttctggaatcctcctacctgtccctcaatttttcactttactaagattataacttatagcttccttgagatagaaatgactctgcagagcccatcctgaatggaaatcataataaataattcctatatccagggaagtctgaaaactaatcttgtttcctgtttttggagcacagtaactggcaaaatacatttggggtgagtttgacttttagagggtggttctgaagcattcttatatgttagattcccttgataaaatggcagattcttgagcttcagcattacaaattgatctggagcgggctctaggaatctaccactttttaattttttgtttgcttgttttatttatttattgtttattattttttattatttttaaatttttttagactgagtt

SEQ ID NO: 344677 - DNA, 747 bp, Homo sapiens
agcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaacgctggaaagaaaggataactttgggtaagtgttggggtcctgtaacatcttcctggcaaaccctgaagggatgatactaagaagacctccccccaacccaaggaaatagactgcagcaccgattggacaactttggaaaacttgagagctgatgggactgctggaaaagatccttcacaaccatcatgcggccacctgaaccgttcagtgtcactgcaatggaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatattttt

SEQ ID NO: 344678 - DNA, 744 bp, Homo sapiens
agcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaacgctggaaagaaaggataactttgggtaagtgttggggtcctgtaacatcttcctggcaaaccctgaagggatgatactaagaagacctccccccaacccaaggaaatagactgcagcaccgattggacaactttggaaaacttgagagctgatgggactgctggaaaagatccttcacaaccatcatgcggccacctgaaccgttcagtgtcactgcaatggaaaacttgagagctgatgggaccgctggaaaagatccttcacaaccatcacgtggccacctgaactgttcagtgtcactgcaacggatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttctttt

SEQ ID NO: 344679 - DNA, 436 bp, Homo sapiens
gagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatattttt

SEQ ID NO: 344680 - DNA, 716 bp, Homo sapiens
ctcgtgatccgcccacctcggcctcccaaagtgctgggattacaggcgtgagccaccgcgcccagctactctagaattacttttaataaataaaattatttcattttctctaagtttccaggattttaaaaacttagaaaatgtttcacttatttctgtttaacagccaagactaatagtgaggaaagattcaacataagtgtggcattaggctgggagtcaaatgataagattctagtcctggctctgaacctattttgctttgaacatgtcacttccacccttggcatcatggagctcatccataaaataactcagacatgatcatctcaaagtctctgtctcgttctgaagttatacaatattatgacctttatagtgagtaaactccctcaatgtgacaggttccctattcttacaaaagctacagtcatacagtactgtggataaacccaaacaaaatgtgccaagtcaggagtgttgaagcaaatgtgatggaagatactggcttgaaatatgggctgaaatacacattaaagtatctcaagagtctttcctgtctacaaaacatcaacattatatgctacagctaaagctctgaaaaactgtgagaaacttaacgattcaaccaagacaacgatctctgctgactcttgaacataagggaaaagctctgaataataatttgacacccaacacccgtagcacccatcctc

SEQ ID NO: 344681 - DNA, 662 bp, Homo sapiens
atggtgacacatgcctgtaatcccagttactcaggaggctgaggcaggagactcacttgaacccgagaggcggaggttgcagtgagccaagatcacaccactgcactccagcctgggcaacagagtgaggaaagattcaacataagtgtggcattaggctgggagtcaaatgataagattctagtcctggctctgaacctattttgctttgaacatgtcacttccacccttggcatcatggagctcatccataaaataactcagacatgatcatctcaaagtctctgtctcgttctgaagttatacaatattatgacctttatagtgagtaaactccctcaatgtgacaggttccctattcttacaaaagctacagtcatacagtactgtggataaacccaaacaaaatgtgccaagtcaggagtgttgaagcaaatgtgatggaagatactggcttgaaatatgggctgaaatacacattaaagtatctcaagagtctttcctgtctacaaaacatcaacattatatgctacagctaaagctctgaaaaactgtgagaaacttaacgattcaaccaagacaacgatctctgctgactcttgaacataagggaaaagctctgaataataatttgacacccaacacccgtagcacccatcctc

SEQ ID NO: 344682 - DNA, 335 bp, Homo sapiens
cacctggccaagagaaaaggaaaatttattgtttcatgtaaccagatctctctctcatttttctctttctttctctaacaggtgttgtggctgttgagctgaagtctcaccatcatagcttgtgttgtaaagcaaggagcagcaagctacgggtctgcaggccaaatttagcctgctgcttgttttgtaaataaagttttaccggcacacagtcatgctcatttgtttctacattgtctatggctgctttcttgctataatggtagatgcagagactgtagggttcataaaacctgaaacatttactctctggccttttacagaaaaagtttacc

SEQ ID NO: 344683 - DNA, 352 bp, Homo sapiens
gctggactgtaatggtgcaatcttggctcaccgcaacctccacatcccgggttcaagtgattctcctgtgtcagcctccagagtagctgggattgcaggtgttgtggctgttgagctgaagtctcaccatcatagcttgtgttgtaaagcaaggagcagcaagctacgggtctgcaggccaaatttagcctgctgcttgttttgtaaataaagttttaccggcacacagtcatgctcatttgtttctacattgtctatggctgctttcttgctataatggtagatgcagagactgtagggttcataaaacctgaaacatttactctctggccttttacagaaaaagtttacc

SEQ ID NO: 344684 - DNA, 321 bp, Homo sapiens
gctggactgtaatggtgcaatcttggctcaccgcaacctccacatcccgggttcaacagcctccagagtagctgggattgcaggtgttgtggctgttgagctgaagtctcaccatcatagcttgtgttgtaaagcaaggtctgcaggccaaatttagcctgctgcttgttttgtaaataaagttttaccggcacacagtcatgctcatttgtttctacattgtctatggctgctttcttgctataatggtagatgcagagactgtagggttcataaaacctgaaacatttactctctggccttttacagaaaaagtttacc

SEQ ID NO: 344685 - DNA, 276 bp, Homo sapiens
tgctgggattacaggcgtgagccactgcgcccggctgcagaatatttttctcgaatttagaaagaacatatataagatcgtggacattaagcaaggaagaagtctaattgcttttaagatatcctctttagctgtatagattaaaaagtaggctgggcacagtgactcatgcctgtaatcctagcactttgggaggccaaggcagcaggatcacttgaagtcaggagtttgagaccagcctggacaacataatgagacctcatctgtacaaattaa

SEQ ID NO: 344686 - DNA, 698 bp, Homo sapiens
agatagggttttaccattggccgggctggtcttgaattcctggcctcaggtggtccgcccacctcggcctcccaaggtgctgcgattacaggcttgagccgccgcacccggccattaatttatattttcagtacgatacatatcatccccccatactaaacaaatcaacccaaaaattttgatttcgcttaatttcgcctaacaaatatctaacatgtatatagcactttatagattaagtgtgttactattttctgtgcagtgggcaggaattataacttctacagatggaaaatggtctcttattgagaagttttttgtcaaaagataaccgtcaaaaggattcatgtccgggtttcatcactgtgtagtcccatactgtttatcactccatcacaatttgaaggctgtctgaaatatccatgaactccactggtaattcatggagttcaactctcttaaccaccctcctccctgacccatgatttttaccctaacagccatgagagtttccaaaaatgttatgttttacttttctagtgtatgtcaaaagacattttgtactgttttaaaattactattcttgctattcaaagaataaaaagtattgtttttcagatgatgggtggatcatgctataaaatggtaacaaagttttggaaataatagctttagattattccaaaaagaaaaaaaaa

SEQ ID NO: 344687 - DNA, 1262 bp, Homo sapiens
tttttgagacggagttttgctcttgtatcccaggctggagtgcaatggcaccatcttggcttactgcaacctccgcctcccgggttcacgccattctcctgctactcggcctcccgagtagctgggattacaggcgtgcatcaccacacccagctaatttttgtatttttagcagagaccaggttttaccatgttggccaggctggtctcgaactcctgacctcaagtgatccccctgccttggcctcccaaagtgctaggattataggcgtgagccaccacgcctggccattttctttcctgtacaattttgtgtgtttgtttttgagttaataatggccgtttttttcatttgattaaatattttactttccaacttaaatcttcccatattcttcagctcaatagagtgcttgtgaatattcttctcctcactgtaaaacctcttggataaagtattttttctctggaagacatgtgtcctgaagtcttccatattcccactctggttgaaacagttactctttaggcatcctgtggtactgggtgccttggagctggtgtgtgtggtactggcatgctgtgtaactgggcgcagtggtactgggtgctgttattgggtgccatggtactgggtgttgtgttattgggtgccatggtactgggtgctgtgttattggcatgcagtggtactgggtgctatgttattgttgtgccgtggtactgggtgctgtgttattggcgtgctgtggtactgagtgctatgttattggtgtgctgtggtactgggtgctgtgtaattagtgtgccgtggtactgggtgctgtgtaattagcgtgccatgatactgggtgctgcattattggcatgctgtggtactgtgtgctgtgttattagtgtgtcctggtacagactagtggccgaggtgtgcctgtgtggagatctgagggtgacgtaagtagaggcactggcgtgagggcccctcatgcagtgtcaggcttgcacctttgcttggaaattccattagctttggaatttatagcttcgtggtgcagtgtggagttatgttggagataccacaaagataaagcatttccatggtgaacaaaaaagtttacaaataaaagcagtccaggccgtttttattttggctttgttatgtgtccacttactgctgtgcattctatacgccaatgggagtgttttgtagattctcatgagttggttgcgtttggttcatttgggtaaagtgaaactccttt

SEQ ID NO: 344688 - DNA, 398 bp, Homo sapiens
cacatatagtgcctattgtgcactaatgtatgttctgagccctttatatgtattagctgatttaagattcaaatatccctgtgaattatgttcatgctatttcatggatgagaaaactgaggcatgtaggtttattagaggaaaatatatcgctgtgtaaaaattggtaaccgatgttcactataagacccagttgacctttgctcatgctgtaactccaagattcaagttggtttcagatatttttaaaactaattaatgtaatatcagaactgactcatctgcactatataatttgaatacatcattgctagtgccagcttgactcttcaacttaattttgcattaatagaaaccttgcagtttataccttaactataagaagaatgaatagtcat

SEQ ID NO: 344689 - DNA, 613 bp, Homo sapiens
cctgggccatggatgggtaccagtagattaggaaccaagttgcacagcaggaggtgagcaggcgagcgaagcttcatctgtatttacagccaccccacaacacttgcattacagcctgagctccgcctcctgtcaggtcagctgtggcattcaactctcataggagcagaaccctattgggaactgcacatgtgagggatctaggttgtgtgctcctgagaatctaatgcccaatgatctgttgatcatcacccccagatgggaccatctagttgcaggaaaacaagctcagggctcccactgactttacattatggtgagctgtgtaattatttcattatatattgcaatgtaataataatagaaaaaaagtgcacagtaaatgtaatgtgcttcaatcatcctgaaaccatcccccttcacctccagtccatggaaaaattatcttccatgaaaccagtccctgatgtcaaaaaggctggggactgctgacctagtggatggtctggggcacagctcttttagggaatagtctattgttgttgttgtttgtttataatttgtataaatttgtgaggcacaagtgcaatttcattacatacataggattgca

SEQ ID NO: 344690 - DNA, 720 bp, Homo sapiens
ttttattgtgcattctgattttaggttgaattcatggttttatggccttaatcatctagcagatacaatacaaacctatttgaccaacaaacccagaagtaacctggccaggcgcagtggcatacacctgtaattccaacacagtgggaggatctcttgatgccaagagtgcaagaccagcctgggcaacatagtcagtggcccggacaatgcttttgatgaacagatgatgagtgacaatgcaagatgaactgtgacaaggatcccgtgggttgtcaaatgagttaagaggaaggaaaaattcctttgggttgccgaggccaagacaagcttcatttcaagcttagtcttgaagatgagtgggattaagataaaaaataaagaatggaaatgagcatgaacaaaaacgtgatggtgaaagcatatttgctattttcaaaagccaggagcagtgctatcagtgacaggcaaacaggcctggaaaagaaggtaccaagacaaggatatcttcaaaatacaggcttgagcacttaatctaaagccagaaaaaaacattggcttcaactgtccatcaaactctattaaatataagaaagtttcctaaatatatcatttttccctgttagaattcattgtctctactgatttcaaaatcagcaaatatttattggaaaaaagaaagaaaaatacttgttaaaatctatttcttaaaaactactg

SEQ ID NO: 344691 - DNA, 286 bp, Homo sapiens
accaggcttttacctgtttatcaaatgcacaattgtcaccccctcttttcctggcattgttttagaccactggcaaggggctgctcagcttgccaaaaggataggattaaatgattggtttttgagattccagtttaccacttaccagccatgtagctttggttattcatttattctttctaagcagccactcacaatgagacaacattttatccttctatgtaaaattggaataatgagtccattgatccttgagtgtccctaaagattaagtcaactcgcacct

SEQ ID NO: 344692 - DNA, 718 bp, Homo sapiens
gcagctgtaacaagacacgatgcaggatctcagctcataactgtgagcagtacggggaagcaacagggccagtcctagccattagggaaacttgggctgctgtttggagaggcagagtgtgagtaggggcggggatggggtggctctgcctggtgtgggatgcagccaccaccagtgctagaagcaaacaccacccccaggatttgagcacgattaattgccctggaggcttaagtcttgagctggatggggcttatatgacccgaccctgggatgatttagggactaggcaagaactgcagagttctgactgaacagcagggacaagaggaaggaactccgcctggactggggcatgaaaggaacacaactcactcctgggaccaggcccaacttccccatggcaggatctcagcagtggcactcatccctcacccaagcattttgccagcagcctgaagatcattccaccccgcctatcatgacattacaccactgtgggggcctgagtgcaagctttcccagtccagctctaccaggctttgacctggctgagaaacagtgcaggatccaggttaccaggggattccacaaccaaacccactacctgaaacactctgaaacaccagagtacttctcccaggggacagaggtcagggataacaccctaccagtaccgcctcagctgcctcatgcctgcaagtaccaccttactggc

SEQ ID NO: 344693 - DNA, 593 bp, Homo sapiens
aaatctttctggtttatgggcgcttgatcctcctttggctttgtggggctgggggggacagatgtggagtggaggatgagggtgggaaactggaatctgatcatgttacatgcccaagggctctcactgaaagtaggcctcaccatcttccccattgcacctctgaaccatgtcattacatgtctaccttagaaaggcctgaaattaaaaaataataataaataaaaaataaattcaaaaaccactccataagaagctgaaaatctgtacttcacatttctttccctgagccctgaggtggtctaagtcttccttcattcattcccacggcctcccgggaaccgtgtcttcatcctgagttatttctgcagtgttccatcaggcatctgcgggtctttaaaggaaatgtgaaaaggtagcaaagacacatctgtgcagcagagacatgtggcacaggaaagaagtgcagaaatcaaagccagggagaagcctgctagccacctagaaatcaaattgtgtcagggagaaagcctgcgtggaaaatagattagaaaggcactgaacaagagagaagaaagaaaggcagcccctgc

SEQ ID NO: 344694 - DNA, 257 bp, Homo sapiens
cctggcatcagggacactgcgctcctgctctcgtctggctgtggctgctccttctcaatctccctagctgctctccatccatctttccttaatgctgcaccaccttccctgccctgggctttttggtcccggtctccttctggccctcaccctgggagagcccatctattctcaggctttgactaccacatgctccttggcccctcccacagggcttcagccctgatgtcagctcagaagtcctcagacccacagac

SEQ ID NO: 344695 - DNA, 583 bp, Homo sapiens
gtttaggagagctaattaaaagacaaaaatattagactgaatttgaaaaatatacaactatgagcttcatgcaagagatacagaaaaataccaatcagaagaaagttggtagatttacattaatagcagatgtgatagttttgtttgtttgtttgttttgggttttgttttgttttgtttttgtggcaatgagggtctcacttcattgcccaggctggtcttgaattcctggcttcaagagatccactcacctttacctcccaaagtgctgggattatggggagacatgatagtttttaaggcaaacaaacaaaagctataaaaatgataaagcaggtcccttcattaggaaaaagtttatttcttccagtaagattgttaattttaaatttatatgtacattaataataaaatgtcataagatataaagtaaaacctgacattattataaaaaggaacaaggaaattcacaatcatagtggaaaaattaacacatctaattcagtaattatagagacaccagtatagatctagaagtatacacaaaataattacaaaaaaagttgtagatatattcatgaac

SEQ ID NO: 344696 - DNA, 1206 bp, Homo sapiens
ctctggatgcttgggggggacggcctgagaaagggcacagcggtgggaggggctgtcttgttccagtgggtcattcacaagtgagttgtatgaagatcttagaacagttcctgcctcctaataagtgctgtatgtgtttctgatgttaattaatattttggggtgctttctctgagccaggcactttgtcagtgctgggattcaaacagttcttgcctcacgtaccttaaattctgtgaggaggagaccaataataaacacatattcaaatgcctgtgttggctggtgataagttgtgtgtagacagtaaagcaaggagcgggagttctgggaagcgggagattgccgttgtattcagggtgatccaggaactcttaggaagtctaattggaaacagcgaccagaaggagggcagggggtgagccacaccggtatctgaggggtggcaagtgtctgagaaagtgtgttccaggcagagggagcagcaggcgcagaggccctggggtgggccatgcctggcctgtgggaggagtgacacggagctgctgtggcctgagtggaggaaggaacgaggatggaagaagacgggaaagcacgggccacaccacagggagcagtgacttctgcacgaagtgttttatttcagtttatcacttgcttattttcaaaacgttttactttgggaattttcaaacataacacaaaagaagagaagataatgtaatgaactgctgcggtgtcatcacccagctttttaagaactcgaaccctggccagtctggcgtcatctctgccagcagcagttctttaaccccctcttcccaggttaccagacagcgtagctcagatctcgtctgatttcctgcatcagtatttcagaatgtcattctaagagaggaagttctcattcacgtttgtggggttcaaaatggtcccatctttggccagtaggaatccctttgggttggcccctgtacccttgtgagagtgccccatggtctttgacagcttccattgttttaagcatgagacaccccagacccattttagacattccttagcccagacttggcatcagccatttctctaaggatccctggttccttttggtgggaaatggcattcacatttggaggccaaatctggatggtagggatggttattgctacagggttatcattgcatctagaaattttcagtgaacag

SEQ ID NO: 344697 - DNA, 365 bp, Homo sapiens
cttttggctgttgtgaataatgctgctttgaatattaatgtacaaatactggtgtgtccttgctttcacttcttttgggtatctacccagaaatggaattgctggatcatatggtaatttctattttttattttttgaggagcccctctatactgttttctatagtggctatgccattttacattcccaccaaccatgcacaaggattttaatttctccacatccttgccaagacttgttattttgttttttttttttactattacattagacattcaaatgggtatgaggtggtaagtcattgatatttagagaccatcattttttttttttttttgtccccgagacgaagtctcgctctgtca

SEQ ID NO: 344698 - DNA, 1084 bp, Homo sapiens
cctcgaactcctgacctcaagtgatccacctgcctcccaaagtgggattacagatacatgaagttatgaatttaagatgtgaagatttacagcttgataaaccagcttcaggagacatgatcttatgaattcaacacatgaagatttacaacttgataaaccagcttcaggagatcagaacttcttataatacaactgacgttactcagcctagaacaaatacaacagggattgtgctgcattctgacttggattctgccatcgaacacagaatgccctgatccttagatgcagaggcagctcttcagcctatgggggctgctgtaaaatattacaggcatactttggagatgttacgggtttggttccacatcactgcaataaagccttccagatatacagtcatatttcttatattacacgactccagcgggaggaagaagaggcctttgccagcagtcagagcagccaaggggcccaatccctcacattctccaagtttgaaggaaagaaaaccaacgagaagacccgcaagattaccacagtgaagaaatcttcagtacgtcttccagggtcggatcaaagaaggtgcctccagaatgagttgagaagataaatggatcagattgaaaagtacatcatgactcatctctataaatatgtgttctgtccagaaactactgatgatgagatgaaagatcttgccattcaaaagaggatcagagtggaagctgctctgtggtgtcagaaagacaaggaatgtggtgacctcacctatccatctccctcaaggcagcttttgagcccttcactgggttacacctcagatgctgtgtgtccctgttaatgaagacatcccagaagtgtctgatacggtgttgaaggcaatcacagggattgtgctgcattctgacttagattctgccatcaaaaacagaatgccctgatccttagaggcagaggcagctcttcagcctatgggcttaagctcttggactcactgaggcagtaaaagaaccatatcctgtgtttgaatcaaaccccgagttcctgtatgtttagaaggtttgccagacaggattcc

SEQ ID NO: 344699 - DNA, 1029 bp, Homo sapiens
cctcgaactcctgacctcaagtgatccacctgcctcccaaagtgggattacagatacatgaagttatgaatttaagatgtgaagatttacagcttgataaaccagcttcaggagacatgatcttatgaattcaacacatgaagatttacaacttgataaaccagcttcaggagggattgtgctgcattctgacttggattctgccatcgaacacagaatgccctgatccttagatgcagaggcagctcttcagcctatgggggctgctgtaaaatattacaggcatactttggagatgttacgggtttggttccacatcactgcaataaagccttccagatatacagtcatatttcttatattacacgactccagcgggaggaagaagaggcctttgccagcagtcagagcagccaaggggcccaatccctcacattctccaagtttgaaggaaagaaaaccaacgagaagacccgcaagattaccacagtgaagaaatcttcagtacgtcttccagggtcggatcaaagaaggtgcctccagaatgagttgagaagataaatggatcagattgaaaagtacatcatgactcatctctataaatatgtgttctgtccagaaactactgatgatgagatgaaagatcttgccattcaaaagaggatcagagtggaagctgctctgtggtgtcagaaagacaaggaatgtggtgacctcacctatccatctccctcaaggcagcttttgagcccttcactgggttacacctcagatgctgtgtgtccctgttaatgaagacatcccagaagtgtctgatacggtgttgaaggcaatcacagggattgtgctgcattctgacttagattctgccatcaaaaacagaatgccctgatccttagaggcagaggcagctcttcagcctatgggcttaagctcttggactcactgaggcagtaaaagaaccatatcctgtgtttgaatcaaaccccgagttcctgtatgtttagaaggtttgccagacaggattcc

SEQ ID NO: 344700 - DNA, 845 bp, Homo sapiens
agaagatagtccttacaaaattatttattgctacagtgcacaacaatgaaagaggggaagcaacccaaatgcacagcggtagaggagagttgaataagtcagttaatataatgcaatgctataaagccaccaaaaatgtttggtgggttagataaatagaagtgtccataaaatatgtaaattatcaaaacatgcattaaatctatttaagagtatgtagatatagcaaaaagaatgagatggtcatggtgagacaccactaggtaggaaggggtccccagaaaaactccagctggcctgtgcactggggtggaacttgaagtttgcaccgttgatagcggggaggagcctggcacctcttcttactgtgtaaaacccattattctagctgctggcagaaagcactctagcagggactctggccttgtgagagtcccaataaaaccctgccttactcaccattcaaaccgtctgtaagcctaaatttttgtggccttgagacggacaaggaccccgtccttagctgaactaaggaaaaatcctgcaacagtggatactggaaataatgttaatggatgggttttactctcctgaaggattaatataatctgtgagtacttttatgcttactgccagtacaaggagtggcttacttactatcagtacaaggagtatatatactctcttgagcttttctgtttggctatttcagtgcctccagaatgagttgagaagataaatggatcagattgaaaagtacatcatgactcatctctataaatatgtgttctgtccagaaactactgatgatgagatgaaagatcttgccattcaaaagaggatca

SEQ ID NO: 344701 - DNA, 609 bp, Homo sapiens
tgtgggcctgggattgtctgagtggtcagtgatgcctcaggctttccctaaactgaaggaggtgacaagacgaatggtcacggtttgtccttggagctcttgtttactgtctctctccctttagagcccttcactgggttacacctcagatgctgtgtgtccctgttaatgaagacatcccagaagtgtctgatacggtgttgaaggcaatcacaggtcagtgaaaccaagagcctttttattgggatgttttccccttaaagttaacattttactgtaatattagtgtataactttgtaaaatgcagattattgaaggtacattggaatgtagtaaaagtgatttgtaagattgttagttttatgaatttgatggcattcagaagagcaggttaactcttttccccctttattttcagggattatggtctcgtttcttgggcattgaactaaactaaggtcaaatacagatagaataattttttttgttctttttttatgtagttttttaaattcagctgactgttcccatgatagaacaaatttcttaagattcagttgcatttatatattcaaaataattttggagagaggaagggaactggtaag

SEQ ID NO: 344702 - DNA, 429 bp, Homo sapiens
ttgatttttcagtgacccttcagaaggccagtccctttggctcctacgtggcactacaggttccatacacctgggatgctgaggccaagccagagcttctcggagtctcgggctacggcttttccctagtgcaatggagacagcaggagacaggtccctaagcaagatgcctggatggtttttggagctgtccatcctacccaggtggggctcattaaccataccaccttggtgagcagctatggagcacatcctaaccctcacgggctaactacctgagatagcctctcaagcttttggagagcctcatacttgtcttgggacctaaacaatgaatgacaggccagcaagcgctgatttcatgctttgtgtggtcaggatgatgtgctcaaggggctggtggaaagatccgatttctctggtgcatga

SEQ ID NO: 344703 - DNA, 374 bp, Homo sapiens
ttggtgtgtatgtacgtatgggaagagaaagagatctctccttgtaaggccaccaattctatcagattagaagcctacctttatgacttcatttaactttaattacctcctaaaagctttatctccaaatacagtcgtattgggggttagagcttcaaaatataaattttgcaggaaaatacaattcagtctgtaacagaggtaatgcccttttgggttgggagtgagtatgattattttgttccagtgagacttgttttctctacgtggaaataatccacagaatataataagcaaaaggggtataatcagggtcctgcagtgatctattaaacacactgcccatgtagaacataagtaagtgcacagtagtg

SEQ ID NO: 344704 - DNA, 356 bp, Homo sapiens
ggaaccaatccttgccttcatggaaccttcattctagttaggggagacagatactagtaaacataattaaaaatgcatagtatattggaaggtgaaagtaatacagaaaaacaacaggagataagggagctttgggaatgtctcaagagtgtaattttaaagtaagtgagtaggagagttgtaatattaaagtgggtgattaagtatcagctttattgagctgatatttgagcaaagttttaagggagttggaagttaaccatgtagttatctgggggaagaacattccaggcagaggaaacaactagtacaaagaccttatggctgaagtgtctttcatatttgaggaatagaag

SEQ ID NO: 344705 - DNA, 139 bp, Homo sapiens
tgaaatacattatttgttaattttgttctttatacaaaaagcagaagttttataactaatgaaacatttatgtaaaagcttctgattttgagtagtaaaatctagtacactaagcagtttgaagggagaatgaatgtta

SEQ ID NO: 344706 - DNA, 399 bp, Homo sapiens
atggaagacattgtgattttgaccttgttggatgctgcacctgaaggtggaggaagaggaagagccttgggggctaccattctggctggagaagcggcacgaggctccctcttgtggatgcagcaaggactgttaaaaaactcccaaagcagggactttcaggcccacatgcacttagcctcctcttcccacctcctgttcctctccgtgtctaatgttccactgccatcgctgccaggaagttctgcagagaagagtgaagaagaaccgtgtgatcctaaacatgttctctgaagatattatcaacccaccattggccttatttactggaatgtttttataaccttcatttgacacctcttcccatcatttaaaataaatctggtgcttccctgaata

SEQ ID NO: 344707 - DNA, 163 bp, Homo sapiens
ctcccactggcactgctcccaggatctccttcctcacttccctaaaatcacagaaaaggggagccactgtcactgggaaaagctagctgttgctcaataatcttcaaagtactacagagtagactgggtcaccaaatgaatttcaggttaaaggctgcaaaat

SEQ ID NO: 344708 - DNA, 402 bp, Homo sapiens
aatcctgggctcaagtcattctcctgcctaggctgtgattacagtgctgggattacaagcatgagccacaggtatttccaattttggttgacactacgtatcactcaattctaaatttcttcattggtggtagatttttaccacagttagtgacttttaactagacagaaaaatatggttagcaatgaaaatatgtacaacacaggtatttaacccaattcatgacatttacccatttttatactcaatgttgtgataaaattaaattttttttttctaaaacaatgtcactatgagacattgtttccaggggaggtacttcaaagtgttgactaatgtatctatatgcgtggtatgggagacaagcaagggcacactaaaggtttttcatgttctattaat

SEQ ID NO: 344709 - DNA, 347 bp, Homo sapiens
agtgagaggctagtcagtagcatcatatggtccactctccagaggagaagacagatgaaggttaagaaaagactccactaggtttggtggttttgaggtcactgatggcctttaagaagatagttttaatactatgatgtgggtgaactaatccaagaagttaaagaataggtacattttaaagaataaactttccaacacagactactctttcaaggatttaggagatgaatgggaggatagagatgaaatgttagctataggatcactagggtcaagggaagacttttttcttttctctttaaattgaaaaaagtaagcatatttgtaggcagaggtaaaggagt

SEQ ID NO: 344710 - DNA, 235 bp, Homo sapiens
ccacccccagccttctttacctgtcttctgtgcctaacaggaaactgcagtgaaagctgctgcccgtacccttcttttcaaggctttctcaaattttggcattgctggacgtttctcatgctttcctgatgtattttctatatatttaaaagtatatttactaaaatatatccaacatttctgcctgtttcttagtttttctgttgttgtttgtttgtttgtttgtttgtttttt

SEQ ID NO: 344711 - DNA, 2015 bp, Homo sapiens
cgcctgtccctcattcccattcaccctgtctgtagtgtcgtttcctttcttctcttctctcttcatgaaattaggggctgtgtgctggaaataaagaagtatgacttatacagcctctcagccacaattcagaactacaaggaagtacaataaaggtgcaggaaaacgtcatgaggttagatgccactcctggtgctgaggaatacacagggggaatgaacacacttggtgaagtaaatcttcaggtgtagcttgagctctgtgacataaaagacttccagttctctccatgacattgaaaactaccttgcttaagtcctttattttactaccatgtaaaacatccaggccggtccttgagatgaaataaatatacaataaatggcagtactcagtctcaggacaaaaccgccatttggcaatttcactttttgccacaagagggcgctttctaaaatagtatttagtccaaccttgacttaattaggtccaaccccagtcctgttgcctgatcgtggacctttcaagttagcatgatcgtggaacttcttaatctgaatatagggtagagtagcgtgaactctatgaaagctgaaaccttcccttgataattcaggtattctcagtgttctagggctgttgtgttcaatgacagtttgtcattgtttagggctaggatatgtatgtggattaaatacagtaaaggtctgaacatgtgctcatctctaaacatatttcttcccacttttaaaaatagggtgcaacaaaattatagttaattgaggtttccatggactgttttttggctaaaataatctaacagtgtcctagctcacaagatactctatcttggtcttgctgaagctttcacggaagaggcgttttcctgccaaccttgaagaaaatgttgagttttgtttgtttttcagaatttagacttaaagagctgaagcagacctcagacatcagctattcctaccacttcacattataggtagtgacactgagacccacagagttaaaaggcctcctcacagctggtacagagctggtcagagcagccatctcattttgtccctttgagggtcagatgtatgcttcttctgcttaaggcacagcctttagggctgccatctggatttctacagagctcatgcaggagaaaaatagccagagcttaagtgctgttgcatagttcagtttatacacctattgtcccatgcctgtttgtgtgtgaggcttccctcgctccgtgggagcaccaggctcatgccctttcataaacctatttgacagaatagagagttttccctcattggtgtagtcaagacaacatgtgtgttcagcatggaaaaaaggtttcaggtcataaacccccttatccctaatgcttactttcataaagaacaacagtggctccactgtattctaaaaggaaaaaggagctctaatgagaaatacgcaattaaacagctatttaggcggcttagaccctttcaggaacaaataaataaatccgtggttttacaaccctgaagtttgataatagctctcttggatttttgtggttacctcatggcaatctcactaagaagcaggggagcaagctcttggcacatgaaggaataggctcatgaagattcatttcttttcccgcttggccttttggttctctaataagctgtgagctgaggtccatgcagggaaaacaaggagggtaacggcaaatgtaaagtgaatttttctggagaaggatgctgattattttatagcatctacactatcctatgatgaaagaggcatagagccgggtggcaatgtgagttcttgggtgatttaataagccatcgagtggatttaatttctaagtaagacatttgtttattctttgtacaagtccatggagttgtgatcttaaagagttctgtgttatttgcattgtgcctcatttctccccatcaaccttagcttgagatttggatgaataaaataaataactggagaaggttaaagta

SEQ ID NO: 344712 - DNA, 430 bp, Homo sapiens
ggcttggcatgaagctgggaccctctagtctgtgaggctgtgctgctcctgggagggctggggaagctccccaccaggctcctccttcctcctaggacagtgccagggaagagactctcacaggcccttgatcccagaggtgcctcagggtgggatggagaccagagtcaaagcacaaaacaaagctggtctgaactgatgaaaaatgaagcatctcaacagaggcaaaataaattttaaaaaaccagccccgagaggccaccaccccatcggacaggtgggattcccgtggataaagtgcccccggcaggtgtgctcctgccatagtgacaacgtctggggaaaacctgtcacagagagaggcacctcccaacacagggacctctgcagccgctggacgaggaattccagagaaacccaaaagatgtaa

SEQ ID NO: 344713 - DNA, 498 bp, Homo sapiens
ctttcagtttttattacattgatggactctctcagcagagaatctaaggagctgtgcacagggtgtggagacactgtgttcttccgatgggggcagagggctgagagcaggggcgtgggagggagaccagaccctgctgtgtgggctgggcaggctgtccagggtgggctgtccagggggcgctgtccagggtgggctgtttggcggggctgtccaggccgtgctctccagcactgacagccacagcaccagggagcagacacagctctcgcttgttgacacaacctagagaaaggcagagggccaggggcacaggcccgaggcccctcagcaggtcagggctggaagtataaacaatgcaacccagacctcaaaatcatatcacagaaattaaagactggggagaaccttggcttcagaacagaaagtattccagtgcccaggagaaactgggtctgcagaggtggaccctggagccagtgttcagccagaggagaa

SEQ ID NO: 344714 - DNA, 399 bp, Homo sapiens
gatttctagaaacacagtttgcaatgccttgaaagtagatgtcaaacaccagctaatgataataactgatatttattaagtactccatgtgcgtgaagttcctctcagcactttacatgtattaattcaaatagaaccaactactttctgaggaggatactgttattattgtccgtattttacagctgaggagaagttgaatgatttgcttcaggtcacagttctagtcaggggagaatagtttacggttccaaccctagcagtcttagacactgcgctctcttagctgctaattaatactgtctctatcatggaacttttatacaaaacataaacttgtagttagtcagcaaaagtaaattttgccaaaaagaaatttggccattttaaccttttttt

SEQ ID NO: 344715 - DNA, 1130 bp, Homo sapiens
gacatgtgaacacctagcgagctccatgggctctgcgtgtgtacgtctttgctgactcagtggccccacacagcaacccgagggccagggcagaaagcacaggaggagccaccacgggtgctgcagggcctcaggctgggcatccatcctctacctgtccttctgccgtccatctgtgggttctccctcaggtgccacgcaaggctggtccttcacaatggcccaggccctcaaactcagtggtcaggagggttcccaccacctcagggcttagcggcagtcaaggtaacctcaggtcctcaggctacctttgcaaataggtccttgcaaagaccctaattcacattcacagatactgggagttaggacttcaacatcttttaggcgggccatgattcaacccatgcatctgggcctaggaagtggaactgccccagtgagcgatgccctgggcactgtgcagttctgggggacacagccctgacagccggaggggggctttctgggcacagagctgtctgggatccgccaaggcaacacaggaaggagtccagagctcacctgggtgagacccgagagctgtcagtgacagcagaatccagagggagcccacatctccaagccaggtccagagctcttccaacaggatagcagtcttgtcaggcactctgggaggccaaagtgggaggatcactttggggccaggagttcgagcaacctgggcaacatagcaagatccctatctctacaaacaaaccaaaaacctcagtagcatctttgttgttttttctcttctgtcaggtattttggtagtagtgatcttctgattttacattccctttttttttttttccatgtagaaatctctatggccatttcctcttgtgaattaattgagtttctaaagtgaactagctgcatgttagaaccaggacttttttgagccctttagagcatgctggcaggcgtcatccccaagccccagggtgggtcatatttctggatgatggaggcagggggtgcaggggtcccctatctgcacattgttctgagtctgatgtgattcctcaactcctccatgaaacaggggccatgcttgtcctcgtctggggcaaactgcagttggagag

SEQ ID NO: 344716 - DNA, 776 bp, Homo sapiens
acgccactgcactccagcctgggtgacagagtgagactctagtctaaaaaaaaaaaaaaattctatccagtccatgaatatttgggaaagaggaatcttcaggttatagaagatgcacaagtttttttcttagtagtttttttgttttgagtaaatatagcggtctggcgatatttaatatagatccttcctaaattacaaatgcattcagaacaaatatacctttctccttttttattataaaacagatacaaggtaaaattcaaatgcagcagtagggtgtcctttgagaatcttttatgcctgtgtgtatcctttaaagtttggtcaaccacactactgtttagatttcctttaataacaaaaagaattataggcttttatgttgatatgactcagtaagctaactgcatctgttttgggtcactttaaaacacctttgcttttgaaaaggaaaagtttctttacagaattgagtatgtaactcttgaagtttactctttcaaagatttgcttttctcctttttcctttcaggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaa

SEQ ID NO: 344717 - DNA, 785 bp, Homo sapiens
tcattaagttcttctatcaaataattattaagcactatgtgccagatgcttttctagacagtgaatatgatgcaattaataaagatttaattaaattcaaatttttactaggttttagttggtctctgattataggtttgtgatatgtgcaaatattggtctcatactttgttatttttgttcttcagtttcatacatattttgactagaacatctgaaactagattaaataaaggagttggccattaattttgaatcacatttattttaatgaaaactaacttttatttttaggagtatctaactatcaagttgaagaagatataggaaagttgaagtcttgtctcactggcttccttcaggaatatggtttatctgtaatggtgaaagatgattatgtccacgaattgtgagtattttttagggtatctaggagatgattccacacctgtcataaggctaatcaaaattcatgtctctgtggtctcctttagttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaa

SEQ ID NO: 344718 - DNA, 876 bp, Homo sapiens
  misc_feature (712)..(712): n is a, c, g, or t
  misc_feature (717)..(717): n is a, c, g, or t
agcggagtgcgcctgcgcgcttgtggagctggtggcggcgctccgcaggggctcggctgttttccgcgcggcaggcgcggccatggcgcagctgggaaagctgctcaaggagcagaagtacgaccggcagctgaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagncatantccatggattcgtgactcataggttacatactttaccccagtggcactcgcggcacctccctgtgccgcatccctttagccggttcagcgccacgcgtgcctctcccgctttggctcgcaccgggactctccactggccccggcgcccctcacctacca

SEQ ID NO: 344719 - DNA, 789 bp, Homo sapiens
agagggtgtggcactgcctctgtgcttctttagagggagctgtcatttccctgcctaatgggatagcttgtgataaggaaacaagatatttttaaagtgctctcccagctcttggagaaagccttcccatctcacagtgattggctttgtgccgcaccctttgttaatcttctcttttaaactggaacagaatctgtatttatctctttacaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattgagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaa

SEQ ID NO: 344720 - DNA, 313 bp, Homo sapiens
  misc_feature (34)..(34): n is a, c, g, or t
  misc_feature (40)..(40): n is a, c, g, or t
catttcaatggcttttggggtacaaagggctttnggtcanaagtttcccaaactatgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaa

SEQ ID NO: 344721 - DNA, 2262 bp, Homo sapiens
  misc_feature (1836)..(1836): n is a, c, g, or t
agcggagtgcgcctgcgcgcttgtggagctggtggcggcgctccgcaggggctcggctgttttccgcgcggcaggcgcggccatggcgcagctgggaaagctgctcaaggagcagaagtacgaccggcagctgaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaaaaaaaaaaacaaaaaaanaaaaaaaaaaaggggggggcgccgcgcgctcaaaaaagttttccccgcggggggccccaagtttagcgcgcgttccccgagtttttttgttcccaagggggcccccctaataggggagccggttttaaaaaaggcaaggacacggggcccggcgcgttttacacaactgctcgggcagtgggggaaaacctgttaaccttggggagaccctttggtgagaagaggaccctttacttctctgggggcggtcgaccattctttggggccaaactatacctaccaggagaattttcaagcgcctcatagagggagcaactttacaacattttcacggtgcttctacgtgcgttaacccacacgcggcatatattgctgcgcggcgtagaaaggttggctgcccgggatatgacttttgactattttttt

SEQ ID NO: 344722 - DNA, 1903 bp, Homo sapiens
agcggagtgcgcctgcgcgcttgtggagctggtggcggcgctccgcaggggctcggctgttttccgcgcggcaggcgcggccatggcgcagctgggaaagctgctcaaggagcagaagtacgaccggcagctgaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattgtgagtattttttagggtatctaggagatgattccacacctgtcataaggctaatcaaaattcatgtctctgtggtctcctttagttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaa

SEQ ID NO: 344723 - DNA, 1916 bp, Homo sapiens
agcggagtgcgcctgcgcgcttgtggagctggtggcggcgctccgcaggggctcggctgttttccgcgcggcaggcgcggccatggcgcagctgggaaagctgctcaaggagcagaagtacgaccggcagctgaggcgattcctccatacatttgacagctgtctgggcccttatggagcatacagtggagtggaaagatggatgctcagcaaacaaaaacaaatgaagccaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaa

SEQ ID NO: 344724 - DNA, 1827 bp, Homo sapiens
accgcagagtcggctgcgtcagcaggcaatggccttggagcaccggcctgagctacccagggagacggtggatctccaggaaaccgcgagtgcctaggagcccctccccaccttttccggggaagccctggtcggagcgagccggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaa

SEQ ID NO: 344725 - DNA, 1981 bp, Homo sapiens
agcggagtgcgcctgcgcgcttgtggagctggtggcggcgctccgcaggggctcggctgttttccgcgcggcaggcgcggccatggcgcagctgggaaagctgctcaaggagcagaagtacgaccggcagctgaggtgtcttctacgtgccatactttgatggagaaaacaggcgtttacggtccatctggttcttctaggcgattcctccatacatttgacagctgtctgggcccttatggagcatacagtggagtggaaagatggatgctcagcaaacaaaaacaaatgaagccaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaa

SEQ ID NO: 344726 - DNA, 1183 bp, Homo sapiens
agcggagtgcgcctgcgcgcttgtggagctggtggcggcgctccgcaggggctcggctgttttccgcgcggcaggcgcggccatggcgcagctgggaaagctgctcaaggagcagaagtacgaccggcagctgaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagattccatcattgtggattagctcggtgcttaaaggattgtggggccaagaggttcaggaatctacctgttcgagggaaatccggatatgttggcgaatcagggcaatttttacatggaaacgtttccgtgaaagcaaggaaagaggttgcgctggggaaaattgggccaatgtgtggcatgtgcgggcgagtctttaaaaa

SEQ ID NO: 344727 - DNA, 1550 bp, Homo sapiens
agcggagtgcgcctgcgcgcttgtggagctggtggcggcgctccgcaggggctcggctgttttccgcgcggcaggcgcggccatggcgcagctgggaaagctgctcaaggagcagaagtacgaccggcagctgagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaa

SEQ ID NO: 344728 - DNA, 1897 bp, Homo sapiens
agcggagtgcgcctgcgcgcttgtggagctggtggcggcgctccgcaggggctcggctgttttccgcgcggcaggcgcggccatggcgcagctgggaaagctgctcaaggagcagaagtacgaccggcagctgaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcattttttagaattccttgtctaatcaaatctctgaagtcctctttttctttatacgttttaggtattcgtccatttgtttcactataccactgtgctaaatatttagctatgatcacaatccatggagtatgactgtggtcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaa

SEQ ID NO: 344729 - DNA, 1141 bp, Homo sapiens
tgctcatacacgattacacaactgtccatttatcggtttttgggttataatattctactgacgccaagttacaggaaccatcatcccctccgacaacatataacagaccattaactgcactaactcctgcatttcttctgcacatgttcatatctgcaacctgtctccatgcgttagtggtgggatcatatacttcaacactttttcgtactaaagggccatcatgacctcctacagcatacaataaattgtttaacacaccaacacctgctccactccgcctggtgctcatttctgctataaagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaa

SEQ ID NO: 344730 - DNA, 839 bp, Homo sapiens
agagggtgtggcactgcctctgtgcttctttagagggagctgtcatttccctgcctaatgggatagcttgtgataaggaaacaagatatttttaaagtgctctcccagctcttggagaaagccttcccatctcacagtgattggctttgtgccgcaccctttgttaatcttctcttttaaactggaacagaatctgtatttatctctttacaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaa

SEQ ID NO: 344731 - DNA, 733 bp, Homo sapiens
accgcagagtcggctgcgtcagcaggcaatggccttggagcaccggcctgagctacccagggagacggtggatctccaggaaaccgcgagtgcctaggagcccctccccaccttttccggggaagccctggtcggagcgagccggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaagtatgttctattctcttcaaatatattcacgttaaggaaggcaaggcctgagtcttagcttcacctcctcagtcagggtgactcgactctcagtggaaatcatccttatgtttgggattatggtgaggaagtgagataatataggtaaagtgctagtacagcatctggcaaatagggcattaataaatgttacccatcattactgtctttattgttattaatacaaaggagtagtcgttattcctttattcatggaatatgggcacttcctaagctcttgtattgatccgtaggtgttagcatataattaacaataatgcctgttgtttgtgatgtcttttaggcttagtctaggggtatctctctttacagtgtcaacaaaaatgctgttttaaagatggcctgtatattattctttaaagat

SEQ ID NO: 344732 - DNA, 214 bp, Homo sapiens
aaggtgattcatgttctagtgctttctctgctattagaaccaaggagaaaacatttcttcacattctcatgtctgagaagggtatacacataattctctgttcttaaagtcacctgtgattcataatattcaccagtcacagtcattacttccagaatatctttcctctgttcaggcagcaattctgcatttcttcgagtggtaagatgtcgat

SEQ ID NO: 344733 - DNA, 1818 bp, Homo sapiens
agcggagtgcgcctgcgcgcttgtggagctggtggcggcgctccgcaggggctcggctgttttccgcgcggcaggcgcggccatggcgcagctgggaaagctgctcaaggagcagaagtacgaccggcagctgaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaa

SEQ ID NO: 344734 - DNA, 2365 bp, Homo sapiens
  misc_feature (1836)..(1836): n is a, c, g, or t
agcggagtgcgcctgcgcgcttgtggagctggtggcggcgctccgcaggggctcggctgttttccgcgcggcaggcgcggccatggcgcagctgggaaagctgctcaaggagcagaagtacgaccggcagctgaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaaaaaaaaaaacaaaaaaanaaaaaaaaaaaaaaaaaaaaaaaaaaagaaaagaaaaaagaaaagaagacaagcagagagaaaaaaaaaaaaacaaaagagaaaggaagagcagagagaatgaaaagcacgacaacagcagcagtagagcaccaggagtgagcacctaaacaagagggagctcagagaaaacgagaagcactagcgacggcgagacaagcaacacgggggagaaaaaacacaagcacacactgagcaaagaggaaaggaaccagaagacaagaagagggacaaacaagacgaaagaaaaagcaaaggagaaaagcgcagaacacaaataggaaccaaaaaaacaaagaacacgcgtaagccaaaataagctgacacagaaacaacacgagataaatacgaagaggaagcaaagaggaaaaaaaagcatcaagagatgacacagatgacagaacaataaaacatacagaggaggctgaagaagagaatgcaaacgagagaacaagacagaaccaccaacaacaacagcagacagcgagaa

SEQ ID NO: 344735 - DNA, 1854 bp, Homo sapiens
agcggagtgcgcctgcgcgcttgtggagctggtggcggcgctccgcaggggctcggctgttttccgcgcggcaggcgcggccatggcgcagctgggaaagctgctcaaggagcagaagtacgaccggcagctgaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattgctaatcaaaattcatgtctctgtggtctcctttagttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaa

SEQ ID NO: 344736 - DNA, 1301 bp, Homo sapiens
  misc_feature (1210)..(1210): n is a, c, g, or t
agcggagtgcgcctgcgcgcttgtggagctggtggcggcgctccgcaggggctcggctgttttccgcgcggcaggcgcggccatggcgcagctgggaaagctgctcaaggagcagaagtacgaccggcagctgaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcngagtatagaacttttactactctgcagctattccgctttcttcgcgtggtccgtgtcacccttccctgttgatcctgtcccggtctccgcc

SEQ ID NO: 344737 - DNA, 1714 bp, Homo sapiens
agcggagtgcgcctgcgcgcttgtggagctggtggcggcgctccgcaggggctcggctgttttccgcgcggcaggcgcggccatggcgcagctgggaaagctgctcaaggagcagaagtacgaccggcagctgaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaa

SEQ ID NO: 344738 - DNA, 1796 bp, Homo sapiens
accgcagagtcggctgcgtcagcaggcaatggccttggagcaccggcctgagctacccagggagacggtggatctccaggaaaccgcgagtgcctaggagcccctccccaccttttccggggaagccctggtcggagcgagccggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaaaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaa

SEQ ID NO: 344739 - DNA, 1390 bp, Homo sapiens
  misc_feature (37)..(37): n is a, c, g, or t
acgcgcggggtttccccgcacgaagaggatccccccngttcctgcttctagaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaa

SEQ ID NO: 344740 - DNA, 1121 bp, Homo sapiens
  misc_feature (840)..(840): n is a, c, g, or t
  misc_feature (846)..(848): n is a, c, g, or t
  misc_feature (1121)..(1121): n is a, c, g, or t
agcggagtgcgcctgcgcgcttgtggagctggtggcggcgctccgcaggggctcggctgttttccgcgcggcaggcgcggccatggcgcagctgggaaagctgctcaaggagcagaagtacgaccggcagctgaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaanaaatgnnnatggggctccagaagatgaccgcagactctgcgccgcacgctactctcccatgtgaacacagccactaacatacatctccagatcccaagccgctctgaagatattttagctgatgatcgctgcattaatctccccaaccgactccatcacttcggatttgagctcgtgccttcaggactctgtggccgggagggttcagggacttttcccgtccgggccaatcctgttgatgccttccgcccatttcgccggcccggttcgggaacgccgcn

SEQ ID NO: 344741 - DNA, 940 bp, Homo sapiens
agcggagtgcgcctgcgcgcttgtggagctggtggcggcgctccgcaggggctcggctgttttccgcgcggcaggcgcggccatggcgcagctgggaaagctgctcaaggagcagaagtacgaccggcagctgaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatgttcttttccaaatgattgcccatgtgccaagtacttccagttcacggcatctcttttaaaaattgctgaccaaaaagatgtctgaagaaagatattttagaaaatatcatttaaacacccatctacctactctcataaaagtagactcagatttccacttggtccaactaccaagtgatctactgctagaagttaactgctaaactagtactattttctgttttaaatgatattgaacaataaataacctcatttcatttttaatcactgaggcaaaggcaatataaatcaccagttcccaccataattaa

SEQ ID NO: 344742 - DNA, 687 bp, Homo sapiens
ccacttgtctgtttcggcttttgttccttgtgcttttgggggtcatatccaaacaaagattgctgaggggccaaattttaaattgtgtataattttaatgacttcagatttaaatagctgcatttggcttatggagtcttttgagcagcatggttttaaaaaggtttttgccaagtggggttctaatggacacctatgcttgtagagctctgatgtgagtgatctgctgtagaaattacttcttttgatttagtatattattttaaaatgcaggtgatgcactggtttcttggtgagggaagctggtttttcctggctgagcttctgtagggtggagggctggagtccaggctctcgctgggcagggaaggcagcttgagtgtgccttccagtcctcctgagggcccacatttttctgggatcacctgttttctgtaatgtgcattgaacacacgggccaggagaagagggaagtagaggagctttgtcctctgtgctcatcctcacagtgctgggcgggccagaaggattcagggccaaccttagggagatgaaggccagttaaaatgttttattgccacaaatggtgtcttttaagaaatgaatccatgtattttacacttaaatgatattaggctactccgggcacactgcctatggggtagccctgctctgcaaggagtagta

SEQ ID NO: 344743 - DNA, 1230 bp, Homo sapiens
tgtatgtaacagagttcctgcatgtcctactttctaatgtgtattctggatataataaaagtgatatcaaatcagagcagtttagaaacagctaaagaaaggaagggaaaagctaggaagctattaaaaccaaatacataggcaagtgagatataatagatgactttctgatagagagcaataagattgaagagccttagaaagtgtttatatgtaaaattcctccaaattataacacttgtgagtattatacatagcaaaactagtttttagaacaccaaaacactgtgaaataattgataatgatttccatgggagggttaaattgggagacaagtgtgaaatacatttaaaagttctattgaaatatctaagaaaaaagttttgccatatctattactgactctgattatggtgtttttttttgtttttgtttttgtttttgttttttgagacgaattcttgttctgtcacccaggctggcgtgcagtggcgcaatctcggctcactgcaacctccgcctcccaggttcaagtgattctcctgcctcagcttccctagtagctgagactacaggcatgtgccaccacgcccggctaattttttgtatttttagtagagactgggtttcaccatgttagcaaggctggtcttgatctcctgaacttgtgatctgcctgcctcagcctcccaaagtgctgagattacaggcatgagccaccatgcctggcctgattatggtgatttttgctgtctagattcccgccccccgcaatatgtctactgaattcctgtccattcctccaaatattttctactaaaatttactacttattattgattgtgtttttccctgttattgtggaatattttttggtcatactcattttgtaaagttaatttaaaattgcattttatgttctagcatattcactaaaccctgcctagttagtgtcatcttaaaatatgaagatctaggccaggtgctgtgtctcacacctctagtcctagcaccttgggaggccaaggcgggtggatcgcttgagctcaggagtttaagaccagcctgggcaacatggcgaaaccctatctttaaaaaaaaaaaacattgcagctacttgtgggggctgaggagggaggattgcttgaacccaggaagtcgaggctgcagtgagctgagatcgtgccgcggcactccagcctgggtgacaaagtgagaccctaattaaa

SEQ ID NO: 344744 - DNA, 550 bp, Homo sapiens
tgtatgtaacagagttcctgcatgtcctactttctaatgtgtattctggatataataaaagtgatatcaaatcagagcagtttagaaacagctaaagaaaggaagggaaaagctaggaagctattaaaaccaaatacataggcaagtgagatataatagatgactttctgatagagagcaataagattgaagagccttagaaagtgtttatatgtaaaattcctccaaattataacacttgtgagtattatacatagcaaaactagtttttagaacaccaaaacactgtgaaataattgataatgatttccatgggagggttaaattgggagacaagtgtgaaatacatttaaaagttctattgaaatatctaagaaaaaagttttgccatatctattactgactctgattatggtgtttttttttgtttttgtttttgtttttgttttttgagacgaattcttgttctgtcacccaggctggcgctgcagtgagctgagatcgtgccgcggcactccagcctgggtgacaaagtgagaccctaattaaa

SEQ ID NO: 344745 - DNA, 705 bp, Homo sapiens
tgaatacagttggtaaatggatgagtccagactcaaatataaggattataggacacaaaagcctacaccctttaaatagcaacatgttctctctccaccacagggaacaaagactaaaggggaaaaagaaagaaccccacaacatggaaacaagcaccagcatccctgcagattagccaaagtattgaaaaggtttaatcttccagttttcctatgttcttcacacaaaccacccagcacatggcaccactgcaataatccccacttttcccaggaaacacagcactgagaactgttcctgttcgaatcgcacactcagctataaaatgggcaggaacgtgggctccagaagatagaaaaatctgtacccttcactcttttattgactttttatctacagtgataaaactttcagcattacaccattaaatttagcctcagatatagtaaaagctaagcatcagactagtttaaatacatggcaaggccaacgaccctacctcaaagcttcatctctggttctgagatcaactgtaccatttaaggctcagaatcacacgctgctcatcaaacacatgctcggctcatatccacttgacacatccatccatccttccaaatgccaccctgctccacacttctgcttgccctgttagcattcccagagcccctcctggcaaggttagtgcttcctccacccccatg

SEQ ID NO: 344746 - DNA, 1467 bp, Homo sapiens
tctgcctgctgtcgggggcgggctggccaggccgaggccggagcaggcaggcatcccccggagttgtctcttttcatgccagcgccaacaggaggctgtctggacacactgattactcactcaccagcctccctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggt

SEQ ID NO: 344747 - DNA, 404 bp, Homo sapiens
ttttcttttgacaaagtgaaatttcaggattaggacaggcaggagcaagagaggctgaaggtgcatctcccccctgggacttcccaaggcccgtcctgcccagtgtcctgtcctcccaggaggagagtggcttcaaatttcaaggttaccatttccagttctcccaggagactctaacctccagcctaggagccacaggtgggggtccagacaggtgccccagctcagggagcgcttttccaggatggaccttggggcctcagaatcactgctgggcggggtgggggtgacaggggcagggttgtgagggctcacagccccatggccatggactgcttccaaacgacaggtgccttctgttgggctcgtagagtgttttatgtttttttgaaagtacgaagttt

SEQ ID NO: 344748 - DNA, 845 bp, Homo sapiens
aagaactggggaataaggattcagagtcctcatttatttcagtttgacatgttcacttgtgcgttattcattgagccatttattcagtggacttatattgaggagtcctgagcatgtgccagaccctgtgctatgcctggaggcaaagcagtaaacaaaagcagactggcccctgcgctcatggaatttagagttgacaagggtgacagatagaaggcaaacattcaggaagcctcaacatgtgtcaggtgctgccctagccctggagatagaacaggaacaaggcagctatgagctgtcctcctggagatggtgatctcatttcagaagggcacgtggcaggtgctgtgggagcaaatcattttacctctcggaacctcggtttccttttctgtaaaataaagatcctcaatagcttcccagcctacttttcagagttgtcatgagaaccaggaaagtgtgtaagaaacttagaagaaagtgttttgtataccctcttcaagatgtgaaaaacctatggacttaatattcttgtcctgcctcggatgttccttctttgcatgatgtcttcagattcaagagttggttttcctttagcttagaagagggaactgtattatcttagaactggaagtaaccctagcggtgattgggtgtaaggccattggagtaatgacctgaggcttagagaggttaggtgactcacccagatcgtgctcctgaagatggactagccagactttgcctgggacctccagtgttcttttcctcctgtgtaacatcctgcctgtttgggaccctgactgttttaactgttgtctcaggtgctctgcagatctgtatgt

SEQ ID NO: 344749 - DNA, 448 bp, Homo sapiens
gtaaccagccagaagtcacacagctagtaggtgatgtagcaaagatggagcccagatggctcagctccagggtccccactcataaccattacttggtgaacacaggaggggatttatcacccaacgtgtccagggctagctgatatcaggcagagtgtaaatgtgagagagctcagacagacacagacacatcctttctggctgatagaggtatggaagtgacgggcacttgagttgggcccctaagggtgaaaagggctcagaggagtttgtcatatgagggcagaaaagtaagaaagcaggcgtggtcaggagagggatcttcgaggggagctgagatcagtacccagagactcctcatccaggccccgcaacttcccagtgaggaaacattgagaggggccaaggatctgcctccacctaaggccaagccaggagtagaagccca

SEQ ID NO: 344750 - DNA, 242 bp, Homo sapiens
aggatattgttgatcacctgctctgggtcgtagtggtagtactccaggcaggccaggatgaagcccccaccctcagccagctggaccgcaacctagagaaatgaaaccagaccctacacccctgctgacgtctcgccacaacgtcttccagaatgacgagtttgatgtgttcagcagggactcagtagacctgagccgggtgcacaagggcaagaggtgagtgcagtgggccatggggttcc

SEQ ID NO: 344751 - DNA, 3017 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggccacctcgtgtatgcagagaccatgtgtgtctgatctgctgggatcctagagctggaacaggagggtcacgcagcacaatgccagctctgcccctggaccaactccagatcacccacaaggacccgaagacaggaaagctgaggacttcaccagcgctgatttgtacctgtaactccatgatacaaatttgatttaaatgggagggggtcctgcagacccacatgagaggtggccttgaagaatccttgtggtacccacaggctctacagtttggaaactcgccaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344752 - DNA, 2672 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggagggtcacgcagcacaatgccagctctgcccctggaccaactccagatcacccacaaggacccgaagacaggaaagctgaggacttcaccagcgctggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344753 - DNA, 2537 bp, Homo sapiens
aatagggcagggctgatgggcattgagtccctgcacagtccacccacaagcccctggggcctaagggataaatcctcgctctcctctgtctcctggtttaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344754 - DNA, 2189 bp, Homo sapiens
acagggtcctgctctgtcaccgaggctagagtgcagtggcacaatcatagctcactgcagccttgaactcctgggctcagttgatcctcccacctcagcctctcaagtagctgggattacaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344755 - DNA, 2888 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggccacctcgtgtatgcagagaccatgtgtgtctgatctgctgggatcctagagctggaacaggagggtcacgcagcacaatgccagctctgcccctggaccaactccagatcacccacaaggacccgaagacaggaaagctgaggacttcaccagcgctgatttgtacctgtaactccatgatacaaatttgatttaaatgggagggggtcctgcagacccacatgagaggtggccttgaagaatccttgtggtacccacaggctctacagtttggaaactcgccaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344756 - DNA, 3277 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaaaaaaaacaagaagagtaaagaggaagagagaaacacaggaagcacaaacaagggggggggagaaaagaggatccccaggggggaggacacagggagagaggacaacacagaatgtgcgatcaaaaagggcgacaccacaagggcagacacgaaatgaaaggacaggccggcgcgagcgagtataaacaagagctcagagaggaaaaacagtgcaagtgtagcaaccttctgatgagaaggaccctctataattgtgggagggtaacacatagtgagcgaaaccactaccctcaacgaaaattttaagagccctagagggtagcaaatataacattatcagcggtgtatatctgtgttgaacacaaagggtggtatattatcttacttgtatcatacaatttgtggcaagtgacgatgataatacggatcagtagaacttttttccg

SEQ ID NO: 344757 - DNA, 1518 bp, Homo sapiens
agctcggtaccccaacgatggtcctcagctccctttggcttgccagaccttccagaagcacgacttttgttacaggcttcttggtgacctgtggcagaggctctcccattccaggaagaagctaatggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344758 - DNA, 3363 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtaggccaccaaggccaggtctctgctgggccagggaaaccaggccagcccctgagccccccagacccatgcttatgccattgcaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaaaaaaaacaagaagagtaaagaggaagagagaaacacaggaagcacaaacaagggggggggagaaaagaggatccccaggggggaggacacagggagagaggacaacacagaatgtgcgatcaaaaagggcgacaccacaagggcagacacgaaatgaaaggacaggccggcgcgagcgagtataaacaagagctcagagaggaaaaacagtgcaagtgtagcaaccttctgatgagaaggaccctctataattgtgggagggtaacacatagtgagcgaaaccactaccctcaacgaaaattttaagagccctagagggtagcaaatataacattatcagcggtgtatatctgtgttgaacacaaagggtggtatattatcttacttgtatcatacaatttgtggcaagtgacgatgataatacggatcagtagaacttttttccg

SEQ ID NO: 344759 - DNA, 2742 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344760 - DNA, 1195 bp, Homo sapiens
  misc_feature (15)..(15): n is a, c, g, or t
acatccggagactcnggaggaagaggagtgcggactggactctctcatctcctgtgcctgcctggagtactaccactacgacccagaagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344761 - DNA, 1618 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggccacctcgtgtatgcagagaccatgtgtgtctgatctgctgggatcctagagctggaacaggagggtcacgcagcacaatgccagctctgcccctggaccaactccagatcacccacaaggacccgaagacaggaaagctgaggacttcaccagcgctgatttgtacctgtaactccatgatacaaatttgatttaaatgggagggggtcctgcagacccacatgagaggtggccttgaagaatccttgtggtacccacaggctctacagtttggaaactcgccaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcacgccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344762 - DNA, 1413 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344763 - DNA, 1167 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatgcagatctggttcaggatgatgtggaaaatctccattagcttcttcctggaat

SEQ ID NO: 344764 - DNA, 800 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggccacctcgtgtatgcagagaccatgtgtgtctgatctgctgggatcctagagctggaacaggtgtcaaggactaggcagactggtcctctcttattactccttctagggtggggatcttcacagtctttataacaggccagaaccaaggttccttgggtaccaggctgtttccacctccttgcctttgctctgctgtttcctctgcctggggcacccttcttccctggccagtctctattatcaagactactcagactctcctctagaagtgctttgactttcactccaccccttcaccccgtctcacccctaagtttaactaaactagacacagtatagtgaatagttaagaaccagcctgcttcaccacccactaactgtgagaccttgggcaagtttcttattttctgtgagcctctgttttgtcactgataaaatgaggataataatagaactaaccttagactttttgtgagcattaatacatgtaaagccagttaacagggcaagtaagttaatgctgagaagagcacttagaggccaggcgctcacacctataatcccagcactttgggaagccaaggtgggcgtattgcttgagcttgggagtttgaaaccagcctgggcaacatggtgaaaccccgtctctatttaaaaaaa

SEQ ID NO: 344765 - DNA, 1097 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggccacctcgtgtatgcagagaccatgtgtgtctgatctgctgggatcctagagctggaacaggagggtcacgcagcacaatgccagctctgcccctggaccaactccagatcacccacaaggacccgaagacaggaaagctgaggacttcaccagcgctgatttgtacctgtaactccatgatacaaatttgatttaaatgggagggggtcctgcagacccacatgagaggtggccttgaagaatccttgtggtacccacaggctctacagtttggaaactcgccaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggtgtgtaggatgcaggactgggaggatgcaccaagatggcccccacatgccaaactaaaggttgcaaaggccagcgctttgacagtgcccagggactcagggcgataggggcagggagtcttgggaaattgcttaacagatatatgagtgtcacctcaaaatgactaggtagtgacactacctagggaggtggaaataaaactgtgtaccagaca

SEQ ID NO: 344766 - DNA, 435 bp, Homo sapiens
gtaaccagccagaagtcacacagctagtaggtgatgtagcaaagatggagcccagatggctcagctccagggtccccactcataaccattacttggtgaacacaggaggggatttatcacccaacgtgtccagggctagctgatatcaggcagagtgtaaatgtgagagagccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344767 - DNA, 712 bp, Homo sapiens
tcctcctgtgtaacatcctgcctgtttgggaccctgactgttttaactgttgtctcaggtgctctgcagatctgtatgtgtggacagaggagaataatgcagtgtattcttttggcaacaggaattaaaggacattgttctctacctttgtgatacctgcaccacactttgggcctttctggatatcttccctttggcttgccagaccttccagaagcacgacttttgttacaggtaaggcggtagttctggctgttgaaatagagatactggcttatgtactaatttaacaaatatttactcatttaacaaatatttactgggtgcttagaatgtaccagtccctcttccagcctggggatgcagcagtgaaaacgacagataagcctcctgcttgtgtggcgcctgcattttagaagcactcctgtttttggccaagaccaggatagggcagggaaaaaaaatacacacacacatacaatgggctgggcgcgttggctcatgcctgtcatcctagcactttgggaggccgaggcgggtggatcacctgaggtcaggagttcaagaccagcctgaccaatatggtgacaccccatctctactaaaaatacaaaaattactgggcatggcagcatgcacctgtattcccagctactgaggaggctgaaacaggagaatcacttgaacccaggtggcggaggttgcagtgagc

SEQ ID NO: 344768 - DNA, 960 bp, Homo sapiens
  misc_feature (849)..(849): n is a, c, g, or t
  misc_feature (854)..(854): n is a, c, g, or t
  misc_feature (856)..(856): n is a, c, g, or t
  misc_feature (863)..(863): n is a, c, g, or t
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggccacctcgtgtatgcagagaccatgtgtgtctgatctgctgggatcctagagctggaacaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcagcttcagaatatcctcagcactgnggttngnaggggcnggggcaaaaccaccccggagtgggggagggccgtggccccagaaatgcccccggaataaggatggcctcctgggactggccactgggctggaattcc

SEQ ID NO: 344769 - DNA, 2831 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344770 - DNA, 2967 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggccacctcgtgtatgcagagaccatgtgtgtctgatctgctgggatcctagagctggaacaggccaagtgatattgtgaaaagaacactggacagcaagacaggagaccttggatctgccactcactgactgtgaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344771 - DNA, 2733 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgagcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344772 - DNA, 2772 bp, Homo sapiens
gaaatatatcagaagtcatctggggaagtatttcttctacaattgagaactgctttatgcaaaaaaagtcactttggctgggttagtaggtgcatgaaccaggtcctgaaccacaacaggagcctcctaaggcgagaggttgaagcttctcttctgactctgggatcagccccagagcaggccctgcccccaggagtctgtgtgtctgctctcttcttcccatccatattcctttcaggagggtcacgcagcacaatgccagctctgcccctggaccaactccagatcacccacaaggacccgaagacaggaaagctgaggacttcaccagcgctggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344773 - DNA, 2756 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacaggcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344774 - DNA, 1912 bp, Homo sapiens
agctcggtaccccaacgatggtcctcagctccttggctgccagaccttccagaagcacgactttgttacactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344775 - DNA, 2917 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtaggccaccaaggccaggtctctgctgggccagggaaaccaggccagcccctgagccccccagacccatgcttatgccattgcaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344776 - DNA, 1331 bp, Homo sapiens
  misc_feature (26)..(26): n is a, c, g, or t
atccccggtcatacctggacttctanaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344777 - DNA, 1103 bp, Homo sapiens
ctattccaggccagcatggccctctgtagctccagcggtgggcaaggggcagacaaggggtcctccaggctggcgagaagcctggccccctgctccaatccaggaagcctgattgcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344778 - DNA, 869 bp, Homo sapiens
tgggcaaccatgagttgtatatgcgccgcaggaagcctgacaccatcgaggtgcagcagatgaaagcccaggcccgggaggagaaagcatcagaagcagctggagcggcaacagctggaaacagagaagaaaaggagagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgcgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaa

SEQ ID NO: 344779 - DNA, 930 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggataaagacacgagacacgaatgttcaggtacacgagctcgaattgtatatgtat

SEQ ID NO: 344780 - DNA, 1393 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggccacctcgtgtatgcagagaccatgtgtgtctgatctgctgggatcctagagctggaacaggagggtcacgcagcacaatgccagctctgcccctggaccaactccagatcacccacaaggacccgaagacaggaaagctgaggacttcaccagcgctgatttgtacctgtaactccatgatacaaatttgatttaaatgggagggggtcctgcagacccacatgagaggtggccttgaagaatccttgtggtacccacaggctctacagtttggaaactcgccaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggtgtgtaggatgcaggactgggaggatgcaccaagatggcccccacatgccaaactaaaggttgcaaaggccagcgctttgacagtgcccagggactcagggcgataggggcagggagtcttgggaaattgcttaacagatatatgagtgtcacctcaaaatgactaggtagtgacactacctagggaggtggaaataaaactgtgtaccagacagttccccagggatctggaaattttttgtttttgttttttttcaggagaatcacttgaacctgggaggcagaagttgcagtgtttgagatggagcaagactccatctcaaaaaaaaaaaaaaaaaaaagacaaagccttgctctgtcactcaggcaagagtgcagtggcgcaatcatatttcactgcagcttcacattcctggagtaaagctatccccccaactcagcctcccaggtacctgggactacaggtgcacaccaccatgcctggcgaattaaaaaaaaaatttttttagt

SEQ ID NO: 344781 - DNA, 1053 bp, Homo sapiens
ggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggccacctcgtgtatgcagagaccatgtgtgtctgatctgctgggatcctagagctggaacaggccaagtgatattgtgaaaagaacactggacagcaagacaggagaccttggatctgccactcactgactgtgaggtcagtttgtgcctttgtagaaaggagcttgcactgtcagttttctatgaattatctttttccctggtccttctctttttccacgtccttcttcccttcttccatgtccttcttcccttcttctcatgtcgttctattcttccacgtacttcttccctgaagcctagaaaggttgcaaaatcttaacatcctccacaagtgaggaaaggcccatggcttcaaccctcaaaagacttaaaatctggctagagttttaaaaggagtgtcctcatatgtagtcattcttcaaacatttggtgaggccacctctgtaccaatcctgtgctcacagaaaagatagcaagaggagagccctgggcattgtcttcatagagctcacaggctactgagctcacagagctggagccataataaagggaatctacatatttttagccagtacttctcaaagtgggtggaaacaggctgggcacagaggctcacacctgtgagcgctttgggaggttgaggcagcactttgggaggccaagacaggaggatcatttgagcccaggagtttgagaccagcccgagtgatgtagtaagaactcatctatcaaaaaataaaacctgtctctacaaaaaattaaaaaattagctggccgtagtggtgcatgcctgtagtcccagctactcagcaggctgaggtgggaggattgctttagctcaagagttagaggccacagtgagctatgatctcaccacttcactggacaacagagtaagactctgtctcttta

SEQ ID NO: 344782 - DNA, 353 bp, Homo sapiens
taacttggtattttcatgaaatttaaggaaatcgttgacccttcaaattagaatgtatcttctgcttctcttctcttctcaggatgttgaaaaaatgacagtactacattatttgattaaatatcaccaggtataattctctcaaagcagttttcagaagttgttatctgaagagtagattcattatttattacacaatattctccctccttatccccattctcccccacaaaaaactcatcagaatgagcttaatacaagcaagattaagactctgacataggggagctggcaagatggccaaataggaagagctctggtctgcagctcccaatgagaccaatgcagagggt

SEQ ID NO: 344783 - DNA, 201 bp, Homo sapiens
tatcatcaggaggtaatattattgaggctcaaggtctgcctattctcttatcacttactataaataactaatttttcctcattttggtatgagaaaggttaacaatgagtctgtgaataaaacagagattatggaacagatcatcactaccctttttcttattcctttcatcttgacattcaacttggaaataataagaat

SEQ ID NO: 344784 - DNA, 710 bp, Homo sapiens
tctcatcctaccaggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccactaccataatcatcgctatccccaccggcgtcaaagtatttagctgactcgccacactccacggaagcaatatgaaatgatctgctgcagtgctctgagccctaggatttatttttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcgctatcatattcatcggcgtaaatctaactttcttcccacaacactttctcggcctatccggaatgccccgacgttactcggactatcccgatgcatacaccacatgaaatatcctatcatctgtaggctcattcatttctctaacagcagtaatattaataattttcatgtggtgtatgcatcggggtagtccgagtaacg

SEQ ID NO: 344785 - DNA, 437 bp, Homo sapiens
ctagaggatccccacctgcaccggtgtccacacctgcaccgggtccatcatccacaaccttaacaatgaacaagatattcgaaaaataggaggactactcaaaaccatacctctcacttcaacctccctcaccattggcagcctagcattagcaggaatacctttcctcacaggtttctactccaaagaccacatcatcgaaaccgcaaacatatcatacacaaacgcctgagcccctatcatattcatcggcgtaaatctaactttcttcccacaacactttctcggcctatccggaatgccccgacgttactcggactatcccgatgcatacaccacatgaaatatcctatcatctgtaggctcattcatttctctaacagcagtaatattaataattttcatgtggtgtatgcatcggggtagtccgagtaacg

SEQ ID NO: 344786 - DNA, 443 bp, Homo sapiens
tcccctgctgctggaaacgctcacagcacaaacacctgctgggttttggtgtcgtatcaatgaaaatctccataattatatcaaaaagctatttattaaaaatatgcttccattttcccactagattttttttttgtatacttcaactagaacaacatatttaccacagactgatgcaggaacagcgaggagaaccctgctgtcttctatgaagccacacattaatggggtttgtacaattttaaggaaatgctcctctaattgctatttgttgttgttgctgttgtttttgggacggagttttactctgtcgcccaggctggagtgcaatggcgccatcttggctcactgcaacctccgcctcccaggttgcgataagctgagatcgcaccactgcactctagcctgagcgacagagcgagactctgactctggtctccaga

SEQ ID NO: 344787 - DNA, 2262 bp, Homo sapiens
aggggagaggaaggaagcgagaccggggctggaggcgggccgaggccgcgagttgagcctcaggaagcagaaggggcgcggaaagatgcgattgacgtcgcaagcgaaccaatgacgagcgagctgtggcaggcctccagccaatgggcagtgaggcctgacgcggggggcggacgctggggccgagggtagcttgagcgcggcggcggcgttgttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttca

SEQ ID NO: 344788 - DNA, 873 bp, Homo sapiens
aggggagaggaaggaagcgagaccggggctggaggcgggccgaggccgcgagttgagcctcaggaagcagaaggggcgcggaaagatgcgattgacgtcgcaagcgaaccaatgacgagcgagctgtggcaggcctccagccaatgggcagtgaggcctgacgcggggggcggacgctggggccgagggtagcttgagcgcggcggcggcgttgttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtgtaagtaaagcttggaaaagtccacagggcatattatggatagagtcttcaaagtctttga

SEQ ID NO: 344789 - DNA, 5805 bp, Homo sapiens
cccattactaatctttgaagacagtcttcaattaactggccaaagaagaatataaagaagtcaggtgtggtgcaaaatgatagtcagagcgagaacattccagagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttgggtcatctctgtccccagtacagatcttggattcataggtggacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaaaaaaaaaaa

SEQ ID NO: 344790 - DNA, 3927 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtaaaaaaaaaaagcaaacagacaagcattcctggccgtcg

SEQ ID NO: 344791 - DNA, 3944 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatca

SEQ ID NO: 344792 - DNA, 4226 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtaaaaaaaaaaaaaaaaaaaaaaaaaaaggggggggggggaaaaaaatttcccggggggggccccattttaggtgtcaccgctttttgtttgtcaaagagggggcggccatagagggggggcgaaattaaagaggagaagacgggggcgcggtttaaacagagcctgtagaggggaaaacggcagcaggcggaattggggagaagacaccttattgggggcgggtgcaaaatttgtggcagacaacacctagagaattaaaggtccgaggaactaaattgaggcgtaggggttaagcacggcatttgtgagggaagattagctacggaatgatgacatc

SEQ ID NO: 344793 - DNA, 5616 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttgggtcatctctgtccccagtacagatcttggattcataggtggacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaaaaaaaaaaa

SEQ ID NO: 344794 - DNA, 5595 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttgggtcatctctgtccccagtacagatcttggattcataggtggacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaaaaaaaaaaa

SEQ ID NO: 344795 - DNA, 4722 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacataatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttgggtcatctctgtccccagtacagatcttggattcataggtggacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaaaaaaaaaaa

SEQ ID NO: 344796 - DNA, 6021 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttggtaagtgcttttgtggttgtcgaaagaaaaagccatatacctgcttctgtgataccgctaagtcaccttcctgagaaggcagagcaaatgtaattttaaatcaaacacaaaactccagttttcgagatatttccattcttttttttaaagtaggtcactgtgtgaaaaaagttttctttgcatgtgaagctgtctgtggtttagatgtcctctgattagatattttcatgttatattatggataacatttgttatttttttggcagcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttgggtcatctctgtccccagtacagatcttggattcataggtggacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaaaaaaaaaaa

SEQ ID NO: 344797 - DNA, 3742 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgaggagtgttttacttcaaatgatgtgatcaattttaaagtaagtgccatatggctatgagaagaatatatattctgttgtttctggatggagagttctgtagatgtctttcatgtccacttgatccagagctgagttcaggtcctgaatatctttgtgaattttctgtctcaatgatctaatatgagaggggtgctgaagtctcccatcatcttgtgctagg

SEQ ID NO: 344798 - DNA, 4764 bp, Homo sapiens
atcccccgggctgcaggattcggcacgagagagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgatgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttgggtcatctctgtccccagtacagatcttggattcataggtggacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaaaaaaaaaaa

SEQ ID NO: 344799 - DNA, 1088 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccacagccatcatcctcctcttcttccattgtatgtggaggaggattaatttcatttggtggtggtggtgg

SEQ ID NO: 344800 - DNA, 2922 bp, Homo sapiens
atcccccgggctgcaggattcggcacgagagcaaaataagtgttaactgtgtttcaaacttgattttctttcctttttcttttttttttcttccagaatgtcttatttaaaaagaaagttttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttgggtcatctctgtccccagtacagatcttggattcataggtggacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaaaaaaaaaaa

SEQ ID NO: 344801 - DNA, 2614 bp, Homo sapiens
  misc_feature (11)..(11): n is a, c, g, or t
tagaggatccnccaccactcctatagatcagtcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttgggtcatctctgtccccagtacagatcttggattcataggtggacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaaaaaaaaaaa

SEQ ID NO: 344802 - DNA, 1835 bp, Homo sapiens
tacctgaccccagccatttcccttctagaaattgttctacagacatatgtaataacatatacaaaaggttattctttcagcagtgtttgtcagagcgagaacattccagagagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtgtgaaaaactagtggtggacacatttggatcacatttatacagttataaaaataaaggtttgattttggtcgttcttca

SEQ ID NO: 344803 - DNA, 5755 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttgggtcatctctgtccccagtacagatcttggattcataggtggacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaaaaaaaaaaa

SEQ ID NO: 344804 - DNA, 3889 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgta

SEQ ID NO: 344805 - DNA, 5177 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttgggtcatctctgtccccagtacagatcttggattcataggtggacattccataagtggggtgacagcaaatgacttgcaggtagtctcattgtaggtttgtgcaccagagtgaccctgtgagcctttgttaataggttgggagctcagggtgtttatgtccacctgtctggtcttccctgtgtgatgttgaccatcactgccatcacatcacctttttttaagtagtaagaataaagccactgtatgattctcttaatagctatacattaatcctggttttagtgctgactgtggacagccttctcggaactggagtctgtctctttcagtcatacatgtttgtttggttggttgttttttgagactgcctcg

SEQ ID NO: 344806 - DNA, 5594 bp, Homo sapiens
cccattactaatctttgaagacagtcttcaattaactggccaaagaagaatataaagaagtcaggtgtggtgcaaaatgatagtcagagcgagaacattccagagagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttgggtcatctctgtccccagtacagatcttggattcataggtggacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaaaaaaaaaaa

SEQ ID NO: 344807 - DNA, 5701 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttgggtcatctctgtccccagtacagatcttggattcataggtggacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaaaaaaaaaaa

SEQ ID NO: 344808 - DNA, 4066 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtaaaaaaaaaaaaaaaaaaaaaaaaaaaggggggggggggaaaaaaatttcccggggggggccccattttaggtgtcaccgctttttgtttgtcaaagagggggcggccatagagggggggcgaaattaaagaggagaagacgggggcgcggtttaaacagagcctgtagaggggaaaacggcagcaggcggaattggggagaagacaccttattgggggcgggtgcaaaatttgtggcagacaacacctagagaattaaaggtccgaggaactaaattgaggcgtaggggttaagcacggcatttgtgagggaagattagctacggaatgatgacatc

SEQ ID NO: 344809 - DNA, 2078 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttca

SEQ ID NO: 344810 - DNA, 4756 bp, Homo sapiens
atcccccgggctgcaggattcggcacgagagagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaagatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttgggtcatctctgtccccagtacagatcttggattcataggtggacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaaaaaaaaaaa

SEQ ID NO: 344811 - DNA, 2249 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtgaaaaaaaaaaaaaaaaaaaaaaaaaaggggggggggggaaaaaaatttcccggggggggccccattttaggtgtcaccgctttttgtttgtcaaagagggggcggccatagagggggggcgaaattaaagaggagaagacgggggcgcggtttaaacagagcctgtagaggggaaaacggcagcaggcggaattggggagaagacaccttattgggggcgggtgcaaaatttgtggcagacaacacctagagaattaaaggtccgaggaactaaattgaggcgtaggggttaagcacggcatttgtgagggaagattagctacggaatgatgacatc

SEQ ID NO: 344812 - DNA, 1664 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaacctaagatgagaccatgtagtggtgtattcgaaggcttgcagtgtcccgaagttgaaactga

SEQ ID NO: 344813 - DNA, 1407 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgagtaagcaaagtgctctggattcataaa

SEQ ID NO: 344814 - DNA, 1295 bp, Homo sapiens
ctaggtcaggccggtttaatcggccgagggttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaaaaaaaaaaaaaaaaaaaaaaactcgagtttttttttttttttttttttttagtcttaggaaacaaaaggtttattgaaatgcatgtagataaattatcatcagcataaaactgttatggagttttcaacatggggtcttttgctcttaaaatgaagtgaagctttgcaagtccattgtccaataggaaaaatattatatctctctgttcagataaagtcctttaaaaaagtaaatctcttttgaaacggtcttttaagcgtctccagcctgtttggctccccccaggtggtgttgctgtccttctccaattgtgagtctgttgaatctcgtgccgctcgtgccgaattcggcacgag

SEQ ID NO: 344815 - DNA, 1255 bp, Homo sapiens
cgccccccggcccggaagtgcgcagcgctggcaagatggcgggaggggtgcgcccgctgaggggcctccgcgccttgtgtcgcgtgctgctcttcctctcgcagttctgcattctgtcgggcggtgaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtct

SEQ ID NO: 344816 - DNA, 1419 bp, Homo sapiens
tattgctatcttcagtgctgctaaggcttcaagtttctgtaaatacgagatgtttctataatatcttgtactagattggggactggggtgttgggtggttttcttctgtgttcctaatgctccctttaccttttagctattcctgcatgtctttgccacagagggactctatctatactctcgcctcttcagggatagactctctttacttgttactctgtgctaggcttatggtgagatagggttttctttgttgtcttgctgcaacctcaatcttagacagatataaaccttagggtggggctgtctcagcaattctgctcttccttcctacggcaattaaattctgccttgtatctgtgatggtcttggacaggagattcctgctctcccctccctcagtgtagcagacttctggttggtactggtataggattctgggcctggaatagcttctttattttatctcagaactaggacatttttgcatctacccttcccacagtaccaaaggattttctcctgtgtccttggtgctagagttttcctacccctcttccagaggcatataagttttgcttctagtctttctataagagcaatggattttgcctgtgccctgtgtgtgggaggatgcggtcccctcccctcaatgtcttaaggcgtttactgcatagaaaggaaggatccaggggaagtgggtggggctttgttcctgtcctccaacagcagctgatcttgtcctgcacacccacatacctgtgcctctgaaggagcagcccccgtttcctgcccactcctaatatgtctcttgagagccctcagtgattttgtgagtgagtgtgactccctgagtttcccagttattccaaacttacatcctaggccacacttggactttaatgatttactaacattttatctgatagcttcatacctaatgggggccacatgtttttcctgtgctcaggcaaaggtgagaaacgccatgtgtctcgtgtctccctggagtgcctgctccctctttggaattctgcttatttggttgccttgccatcttagatctttgatagactcaagaaaaattataatgttggtacactagccaggtttttttattattctttgcagctttctacatcccacatggaagcagcaatgagatgttttaaaacgagatgtttcaaaatcaccatctcactctagtttgtctacaaagccatctatcaagaacattatatgaacttttaaatacattcttctgtatttatagaatgatttttaaagcatttccagccatgtttaaaagctgtgaatagtcttttttttgtaacctagtaaccaaagttattaatgaaagtcacagttaaacttttttcctttgaaaataaaatgaatcaacacataacgagaaggtta

SEQ ID NO: 344817 - DNA, 629 bp, Homo sapiens
cgccccccggcccggaagtgcgcagcgctggcaagatggcgggaggggtgcgcccgctgaggggcctccgcgccttgtgtcgcgtgctgctcttcctctcgcagttctgcattctgtcgggcggtgagcaatcgcaggcgctggctcagtcaataaaggatccgggcccaacacgcacattcacagtagttcccagggcagcagaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttggtaccgtactttccccaaaggctttttccccattgacctgcccgctccccctggtccccggctctggctctaccccttacccctcgttggttt

SEQ ID NO: 344818 - DNA, 1334 bp, Homo sapiens
cgccccccggcccggaagtgcgcagcgctggcaagatggcgggaggggtgcgcccgctgaggggcctccgcgccttgtgtcgcgtgctgctcttcctctcgcagttctgcattctgtcgggcggtgaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaagaaata

SEQ ID NO: 344819 - DNA, 1462 bp, Homo sapiens
cgccccccggcccggaagtgcgcagcgctggcaagatggcgggaggggtgcgcccgctgaggggcctccgcgccttgtgtcgcgtgctgctcttcctctcgcagttctgcattctgtcgggcggtgaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaagaaataaaaaaagggggggcaaaattcctagggcaattggttccggtttgacaagggctatgggtgataacagcgggggttaagtgaggaaggtgggtgagacattggggaggacccgatggcgtaaaagtggc

SEQ ID NO: 344820 - DNA, 3001 bp, Homo sapiens
cacagctggccgtgggcagaattctgctttaattgcaggtgtctctgactccagtcccatgcttcttcccttccagtgcagtgtctacttgctaatgatcacgtctcttaaccttagaagattgttctctgttattcgaatcagtattataggagaataagcttctctcttgcctctcacagaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttggtaggtcagagttcaaggacatttgtcaacaaaatgtttttctccaagtttattgaagggactttaaccagaaatttgcgagtcaagttacttaattagaaacatttatcagcagctctttagatgtgccaagcatcatcaataaactcaacgtactaaagtaaagcatccagaaaattgcagttctttttaaatgtaatatttgataaaataagaaaaacatttgaagtataaagcataatacacagtaattgacctttacccaaaataacaatgaaagcagcaccaataccattgcggccgcctgagtgcctgagtgcctgagtgcctgagtgcctgagtgcctgagtgcctgagtgcctgagtgcttgccttcacctggttgcctttcctcctcttccaaggtaaccacccttttgaattttttatttcacttccttttaaattttttctgtagttttattgtctatatgtaataaaataatattcaataatgcatgttttagaaccgtgtaaaatgatttcaggctgtgtgctcttctgggacttgcttatttcctaaacattgtggctctaggattcatccacgtgacttctcttcttttttttacttctgtgtaataatctattgtaagattgtatcacagtttattctccaatatatttggttaagtgctgttttccgctgttgtgactgttcaaatttctttgcctgtctcccaatggcacaggtgcaagagcttcttcagcatgtactttccagcgtgtgtcattctttaaatggctgtattgactggcattcccacccgcgctatgtaactgttcctgatgagccatattctctccaagagtggttattcttaaatttggtcgtaaagttgtctagacttcttttatattttggatattacctgtgctgtccctgaaaccctctcccagattttgattttttttttttttttgcattattgtatattttcatgaacagaactttaaaaatataattactggaagttattagagttagtccttttttgtggtggttttaagaaatctttttctaccccaggttaataaagacaatttgctacattttcttttgaaagttgtaagtataacatttcacatttaggtttagaatccacctggaattggtcctggtagatggtgtgaggtagattctactttaattgtccccccacatggatggccagttgtctcaactcttccctgttgatccgtgtgtgacctctgtcataacactcatacatgaagtgtttgtatatttctggttcttgactttctcttcttttcctattgggtgatttttatgcctcaagactacactgtcttatatactcgtaacttccccgtaggtcttgatatgtgggtgagcatttcatgttcctcacgttgtaatcctaacttagctgatttaaatattacatctatgtagatagatggtaagcgctttgtactcttcacttcaacatgtattaccgtaaagagagttgacttttcacattttaaattttgagcccatttgttacaattaagtctttctgagagtattttttataccctgtatttttctttcttttttttttttaaggtaaccgtacttttcccaaaatgctatattgcaattggactggaggctataagtggtctacggctctggctctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaagaaata

SEQ ID NO: 344821 - DNA, 1727 bp, Homo sapiens
cgccccccggcccggaagtgcgcagcgctggcaagatggcgggaggggtgcgcccgctgaggggcctccgcgccttgtgtcgcgtgctgctcttcctctcgcagttctgcattctgtcgggcggtgaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaagaaataaaaaaaaaaaaaaaaaaaaaaaaaaaaaaaaagaaaaaaaaaaagaaaaaaaaaataaaacaacaaaacaaaaatagaaacaaggcggcgggcgccgccccgcaatcaaaatgctcccctgcgaggaggggcgcaccacaagtaaggtcgacgccacgccaccagcttgtttgtggaaagacaaggagccgcgcccccctaagatgaggggcgcctcattacatcaacaacacacgtccgcggtgcgcgagcgcggctttaaacaaacacgcagctcgcagcggggaacaaaactcgtcacctgcctggacgaatccatcggggagaaagcaccacctcctctgtctggggtggcagccgcaccctggtgggcgcaccaccccacccagagat

SEQ ID NO: 344822 - DNA, 2439 bp, Homo sapiens
cgccccccggcccggaagtgcgcagcgctggcaagatggcgggaggggtgcgcccgctgaggggcctccgcgccttgtgtcgcgtgctgctcttcctctcgcagttctgcattctgtcgggcggtgaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttggtaggtcagagttcaaggacatttgtcaacaaaatgtttttctccaagtttattgaagggactttaaccagaaatttgcgagtcaagttacttaattagaaacatttatcagcagctctttagatgtgccaagcatcatcaataaactcaacgtactaaagtaaagcatccagaaaattgcagttctttttaaatgtaatatttgataaaataagaaaaacatttgaagtataaagcataatacacagtaattgacctttacccaaaataacaatgaaagcagcaccaataccattgcggccgcctgagtgcctgagtgcctgagtgcctgagtgcctgagtgcctgagtgcctgagtgcctgagtgcttgccttcacctggttgcctttcctcctcttccaaggtaaccacccttttgaattttttatttcacttccttttaaattttttctgtagttttattgtatattttcatgaacagaactttaaaaatataattactggaagttattagagttagtccttttttgtggtggttttaagaaatctttttctaccccaggttaataaagacaatttgctacattttcttttgaaagttgtaagtataacatttcacatttaggtttagaatccacctggaattggtcctggtagatggtgtgaggtagattctactttaattgtccccccacatggatggccagttgtctcaactcttccctgttgatccgtgtgtgacctctgtcataacactcatacatgaagtgtttgtatatttctggttcttgactttctcttcttttcctattgggtgatttttatgcctcaagactacactgtcttatatactcgtaacttccccgtaggtcttgatatgtgggtgagcatttcatgttcctcacgttgtaatcctaacttagctgatttaaatattacatctatgtagatagatggtaagcgctttgtactcttcacttcaacatgtattaccgtaaagagagttgacttttcacattttaaattttgagcccatttgttacaattaagtctttctgagagtattttttataccctgtatttttctttcttttttttttttaaggtaaccgtacttttcccaaaatgctatattgcaattggactggaggctataagtggtctacggctctggctctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaagaaata

SEQ ID NO: 344823 - DNA, 1332 bp, Homo sapiens
cacagctggccgtgggcagaattctgctttaattgcaggtgtctctgactccagtcccatgcttcttcccttccagtgcagtgtctacttgctaatgatcacgtctcttaaccttagaagattgttctctgttattcgaatcagtattataggagaataagcttctctcttgcctctcacagaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttggccgtacttttcccctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaagaaata

SEQ ID NO: 344824 - DNA, 1610 bp, Homo sapiens
cgccccccggcccggaagtgcgcagcgctggcaagatggcgggaggggtgcgcccgctgaggggcctccgcgccttgtgtcgcgtgctgctcttcctctcgcagttctgcattctgtcgggcggtgaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagtctgcaggcccaggtggggcttcatgttcagctcactgttggacttcattgacatcaccctgaaaaaggtggatttttgaggagcgtgagaagaagagcatgagaagtgctgaattacactgtgttgttgcagatgagcgtccctaaccacagcagtccttgaagaagaaagatggtctgataggaactgcttattcaggaacacattgcaaaatctgtgggtgtccttcgggatctgagggcctcactcctacaactgcaaggaattgaattcttctaacagtgtgatgaggttggaagaagactccaagatccagaaaggaacacagtcccaccaacacctgtgttgtaacctggtgacaccctgaaacagagaatccagctaagcgatgcccaaaatattcatccacaacgtgttgttttaagcttccaagtttctagtaatttgttataaagcaatagaaaagtaatatatccttatccgaggctcatcttcattccaaacgttccacatttccttctgttatcatttattttctgtcggaattacttcctccagcaaaaaaatttttaaggcagttctgctgcacttgaaaagtcttatgacacgtccttctggccttcatgatttctgctgaaaaatatgctgtcatttgaatagttttaatgcttgagatgaacccggtacctcagatggaaatgcagaaatcacccgtcttctgcgtcgctcacgctgggagctgtagactggagctgttcctattcggacatcttggctcctcccgtgctttctacatcccacatggaagcagcaatgagatgttttaaaacgagatgtttcaaaatcaccatctcactctagtttgtctacaaagccatctatcaagaacattatatgaacttttaaatacattcttctgtatttatagaatgatttttaaagcatttccagccatgtttaaaagctgtgaatagtcttttttttgtaacctagtaaccaaagttattaatgaaagtcacagttaaacttttttcctttgaaaataaaatgaatcaacacataacgagaaggtta

SEQ ID NO: 344825 - DNA, 3115 bp, Homo sapiens
cgccccccggcccggaagtgcgcagcgctggcaagatggcgggaggggtgcgcccgctgaggggcctccgcgccttgtgtcgcgtgctgctcttcctctcgcagttctgcattctgtcgggcggtgaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttggtaggtcagagttcaaggacatttgtcaacaaaatgtttttctccaagtttattgaagggactttaaccagaaatttgcgagtcaagttacttaattagaaacatttatcagcagctctttagatgtgccaagcatcatcaataaactcaacgtactaaagtaaagcatccagaaaattgcagttctttttaaatgtaatatttgataaaataagaaaaacatttgaagtataaagcataatacacagtaattgacctttacccaaaataacaatgaaagcagcaccaataccattgcggccgcctgagtgcctgagtgcctgagtgcctgagtgcctgagtgcctgagtgcctgagtgcctgagtgcttgccttcacctggttgcctttcctcctcttccaaggtaaccacccttttgaattttttatttcacttccttttaaattttttctgtagttttattgtctatatgtaataaaataatattcaataatgcatgttttagaaccgtgtaaaatgatttcaggctgtgtgctcttctgggacttgcttatttcctaaacattgtggctctaggattcatccacgtgacttctcttcttttttttacttctgtgtaataatctattgtaagattgtatcacagtttattctccaatatatttggttaagtgctgttttccgctgttgtgactgttcaaatttctttgcctgtctcccaatggcacaggtgcaagagcttcttcagcatgtactttccagcgtgtgtcattctttaaatggctgtattgactggcattcccacccgcgctatgtaactgttcctgatgagccatattctctccaagagtggttattcttaaatttggtcgtaaagttgtctagacttcttttatattttggatattacctgtgctgtccctgaaaccctctcccagattttgattttttttttttttttgcattattgtatattttcatgaacagaactttaaaaatataattactggaagttattagagttagtccttttttgtggtggttttaagaaatctttttctaccccaggttaataaagacaatttgctacattttcttttgaaagttgtaagtataacatttcacatttaggtttagaatccacctggaattggtcctggtagatggtgtgaggtagattctactttaattgtccccccacatggatggccagttgtctcaactcttccctgttgatccgtgtgtgacctctgtcataacactcatacatgaagtgtttgtatatttctggttcttgactttctcttcttttcctattgggtgatttttatgcctcaagactacactgtcttatatactcgtaacttccccgtaggtcttgatatgtgggtgagcatttcatgttcctcacgttgtaatcctaacttagctgatttaaatattacatctatgtagatagatggtaagcgctttgtactcttcacttcaacatgtattaccgtaaagagagttgacttttcacattttaaattttgagcccatttgttacaattaagtctttctgagagtattttttataccctgtatttttctttcttttttttttttaaggtaaccgtacttttcccaaaatgctatattgcaattggactggaggctataagtggtctacggctctggctctaagagttggactcttcatcgacactgtgaccacaccactgcactccagcctgagccacagagcgagacactgtctctaaaaaataaaagaaaaagaaaacacaataacaagtattgatgagaatgtggagaaattggaaccttcatatattgctggtggggatgtaaagtgatgtagctgcccaggaaaacagtctggcaatttgtgaaaatgttaaacatagagttaccatgtgacttggggaatcttctaggtatacacccaagagaagtggagatatgttgtgaaagttgtcagcaccaaaatggggtcacttaggtcaaaccctagcaaaatgaatccgggaggccctgaaggaggagtactcacgcacatgtacctatgataagaactattacaaggactccctggaaaccataaacactccatgttaagctgctgctgtgaagacatctccccagcaacagccagcgtgaccaatgaggagctatgagcttcaacagtcaagagtttttgtttcaaaccagcttacatgactttctcctttttgtctttataaaagtttgccttgaccccagcatctttgggtgtttcttggttcattgtggcatgggtatcttggattgcaatcccccaccaatcccagataaactcctttggagagcctatctgtctattgttattttaggttttaggacatacactaaaaaactcgtttacagcaccattattcatagtaaaaaagtggaaacaacccaaatgtcccactgatgaataatacataaacaaaatgtagttcattcatataatggaatactatttcatcacataaaggaatgaagtactgatacacaccataaggtgaataaacctcaaaaacacggtgctaagggaagaaagccagttacactttaagctggtaacctttacagcatataaattacttcttaataaagcggtcttaaaaaaaaa

SEQ ID NO: 344826 - DNA, 1504 bp, Homo sapiens
cgccccccggcccggaagtgcgcagcgctggcaagatggcgggaggggtgcgcccgctgaggggcctccgcgccttgtgtcgcgtgctgctcttcctctcgcagttctgcattctgtcgggcggtgaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagagttggactcttcatcgacactgtgaccacaccactgcactccagcctgagccacagagcgagacactgtctctaaaaaataaaagaaaaagaaaacacaataacaagtattgatgagaatgtggagaaattggaaccttcatatattgctggtggggatgtaaagtgatgtagctgcccaggaaaacagtctggcaatttgtgaaaatgttaaacatagagttaccatgtgacttggggaatcttctaggtatacacccaagagaagtggagatatgttgtgaaagttgtcagcaccaaaatggggtcacttaggtcaaaccctagcaaaatgaatccgggaggccctgaaggaggagtactcacgcacatgtacctatgataagaactattacaaggactccctggaaaccataaacactccatgttaagctgctgctgtgaagacatctccccagcaacagccagcgtgaccaatgaggagctatgagcttcaacagtcaagagtttttgtttcaaaccagcttacatgactttctcctttttgtctttataaaagtttgccttgaccccagcatctttgggtgtttcttggttcattgtggcatgggtatcttggattgcaatcccccaccaatcccagataaactcctttggagagcctatctgtctattgttattttaggttttaggacatacactaaaaaactcgtttacagcaccattattcatagtaaaaaagtggaaacaacccaaatgtcccactgatgaataatacataaacaaaatgtagttcattcatataatggaatactatttcatcacataaaggaatgaagtactgatacacaccataaggtgaataaacctcaaaaacacggtgctaagggaagaaagccagttacactttaagctggtaacctttacagcatataaattacttcttaataaagcggtcttaaaaaaaaa

SEQ ID NO: 344827 - DNA, 1412 bp, Homo sapiens
cgccccccggcccggaagtgcgcagcgctggcaagatggcgggaggggtgcgcccgctgaggggcctccgcgccttgtgtcgcgtgctgctcttcctctcgcagttctgcattctgtcgggcggtgagcaatcgcaggcgctggctcagtcaataaaggatccgggcccaacacgcacattcacagtagttcccagggcagcagaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaagaaata

SEQ ID NO: 344828 - DNA, 2945 bp, Homo sapiens
cgccccccggcccggaagtgcgcagcgctggcaagatggcgggaggggtgcgcccgctgaggggcctccgcgccttgtgtcgcgtgctgctcttcctctcgcagttctgcattctgtcgggcggtgaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttggtaggtcagagttcaaggacatttgtcaacaaaatgtttttctccaagtttattgaagggactttaaccagaaatttgcgagtcaagttacttaattagaaacatttatcagcagctctttagatgtgccaagcatcatcaataaactcaacgtactaaagtaaagcatccagaaaattgcagttctttttaaatgtaatatttgataaaataagaaaaacatttgaagtataaagcataatacacagtaattgacctttacccaaaataacaatgaaagcagcaccaataccattgcggccgcctgagtgcctgagtgcctgagtgcctgagtgcctgagtgcctgagtgcctgagtgcctgagtgcttgccttcacctggttgcctttcctcctcttccaaggtaaccacccttttgaattttttatttcacttccttttaaattttttctgtagttttattgtctatatgtaataaaataatattcaataatgcatgttttagaaccgtgtaaaatgatttcaggctgtgtgctcttctgggacttgcttatttcctaaacattgtggctctaggattcatccacgtgacttctcttcttttttttacttctgtgtaataatctattgtaagattgtatcacagtttattctccaatatatttggttaagtgctgttttccgctgttgtgactgttcaaatttctttgcctgtctcccaatggcacaggtgcaagagcttcttcagcatgtactttccagcgtgtgtcattctttaaatggctgtattgactggcattcccacccgcgctatgtaactgttcctgatgagccatattctctccaagagtggttattcttaaatttggtcgtaaagttgtctagacttcttttatattttggatattacctgtgctgtccctgaaaccctctcccagattttgattttttttttttttttgcattattgtatattttcatgaacagaactttaaaaatataattactggaagttattagagttagtccttttttgtggtggttttaagaaatctttttctaccccaggttaataaagacaatttgctacattttcttttgaaagttgtaagtataacatttcacatttaggtttagaatccacctggaattggtcctggtagatggtgtgaggtagattctactttaattgtccccccacatggatggccagttgtctcaactcttccctgttgatccgtgtgtgacctctgtcataacactcatacatgaagtgtttgtatatttctggttcttgactttctcttcttttcctattgggtgatttttatgcctcaagactacactgtcttatatactcgtaacttccccgtaggtcttgatatgtgggtgagcatttcatgttcctcacgttgtaatcctaacttagctgatttaaatattacatctatgtagatagatggtaagcgctttgtactcttcacttcaacatgtattaccgtaaagagagttgacttttcacattttaaattttgagcccatttgttacaattaagtctttctgagagtattttttataccctgtatttttctttcttttttttttttaaggtaaccgtacttttcccaaaatgctatattgcaattggactggaggctataagtggtctacggctctggctctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaagaaata

SEQ ID NO: 344829 - DNA, 3520 bp, Homo sapiens
cgccccccggcccggaagtgcgcagcgctggcaagatggcgggaggggtgcgcccgctgaggggcctccgcgccttgtgtcgcgtgctgctcttcctctcgcagttctgcattctgtcgggcggtggtgagtcaaaggctgggttcagcgccgggtggggctgagtggcagcagggccccgggagctgcgaggaggccgggcccacgggcggacgctgacgcggggaggaggccgagtgccgggctccgggccgcttgtcgctgcatctggagtctggcgccctggccgcccggcccgaggccgcccctccgctccggcgacaccgagcccgccatcgcggctgcggagccctggcacggagatggagcgcttgggggctgggccggggaggcggaactggagcgcgatgtcatccttcggtccctcgttgccggctgacctgaactgatgtctactctgttgacgtttcgtccctaagctttgtgttttctggctgaccagccgtgaggttttcatgagcagcttattggcctggtgtagacccgccgtgttaaccacacaaaataaggttttcttgtcccgggataacgtgtttctctaattgtacgatccttaaatttagagcaatcgcaggcgctggctcagtcaataaaggatccgggcccaacacgcacattcacagtagttcccagggcagcagaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttggtaggtcagagttcaaggacatttgtcaacaaaatgtttttctccaagtttattgaagggactttaaccagaaatttgcgagtcaagttacttaattagaaacatttatcagcagctctttagatgtgccaagcatcatcaataaactcaacgtactaaagtaaagcatccagaaaattgcagttctttttaaatgtaatatttgataaaataagaaaaacatttgaagtataaagcataatacacagtaattgacctttacccaaaataacaatgaaagcagcaccaataccattgcggccgcctgagtgcctgagtgcctgagtgcctgagtgcctgagtgcctgagtgcctgagtgcctgagtgcttgccttcacctggttgcctttcctcctcttccaaggtaaccacccttttgaattttttatttcacttccttttaaattttttctgtagttttattgtctatatgtaataaaataatattcaataatgcatgttttagaaccgtgtaaaatgatttcaggctgtgtgctcttctgggacttgcttatttcctaaacattgtggctctaggattcatccacgtgacttctcttcttttttttacttctgtgtaataatctattgtaagattgtatcacagtttattctccaatatatttggttaagtgctgttttccgctgttgtgactgttcaaatttctttgcctgtctcccaatggcacaggtgcaagagcttcttcagcatgtactttccagcgtgtgtcattctttaaatggctgtattgactggcattcccacccgcgctatgtaactgttcctgatgagccatattctctccaagagtggttattcttaaatttggtcgtaaagttgtctagacttcttttatattttggatattacctgtgctgtccctgaaaccctctcccagattttgattttttttttttttttgcattattgtatattttcatgaacagaactttaaaaatataattactggaagttattagagttagtccttttttgtggtggttttaagaaatctttttctaccccaggttaataaagacaatttgctacattttcttttgaaagttgtaagtataacatttcacatttaggtttagaatccacctggaattggtcctggtagatggtgtgaggtagattctactttaattgtccccccacatggatggccagttgtctcaactcttccctgttgatccgtgtgtgacctctgtcataacactcatacatgaagtgtttgtatatttctggttcttgactttctcttcttttcctattgggtgatttttatgcctcaagactacactgtcttatatactcgtaacttccccgtaggtcttgatatgtgggtgagcatttcatgttcctcacgttgtaatcctaacttagctgatttaaatattacatctatgtagatagatggtaagcgctttgtactcttcacttcaacatgtattaccgtaaagagagttgacttttcacattttaaattttgagcccatttgttacaattaagtctttctgagagtattttttataccctgtatttttctttcttttttttttttaaggtaaccgtacttttcccaaaatgctatattgcaattggactggaggctataagtggtctacggctctggctctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaagaaata

SEQ ID NO: 344830 - DNA, 1777 bp, Homo sapiens
cgccccccggcccggaagtgcgcagcgctggcaagatggcgggaggggtgcgcccgctgaggggcctccgcgccttgtgtcgcgtgctgctcttcctctcgcagttctgcattctgtcgggcggtggtgagtcaaaggctgggttcagcgccgggtggggctgagtggcagcagggccccgggagctgcgaggaggccgggcccacgggcggacgctgacgcggggaggaggccgagtgccgggctccgggccgcttgtcgctgcatctggagtctggcgccctggccgcccggcccgaggccgcccctccgctccggcgacaccgagcccgccatcgcggctgcggagccctggcacggagatggagcgcttgggggctgggccggggaggcggaactggagcgcgatgtcatccttcggtccctcgttgccggctgacctgaactgatgtctactctgttgacgtttcgtccctaagctttgtgttttctggctgaccagccgtgaggttttcatgagcagcttattggcctggtgtagacccgccgtgttaaccacacaaaataagaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaagaaata

SEQ ID NO: 344831 - DNA, 1851 bp, Homo sapiens
cgccccccggcccggaagtgcgcagcgctggcaagatggcgggaggggtgcgcccgctgaggggcctccgcgccttgtgtcgcgtgctgctcttcctctcgcagttctgcattctgtcgggcggtggtgagtcaaaggctgggttcagcgccgggtggggctgagtggcagcagggccccgggagctgcgaggaggccgggcccacgggcggacgctgacgcggggaggaggccgagtgccgggctccgggccgcttgtcgctgcatctggagtctggcgccctggccgcccggcccgaggccgcccctccgctccggcgacaccgagcccgccatcgcggctgcggagccctggcacggagatggagcgcttgggggctgggccggggaggcggaactggagcgcgatgtcatccttcggtccctcgttgccggctgacctgaactgatgtctactctgttgacgtttcgtccctaagctttgtgttttctggctgaccagccgtgaggttttcatgagcagcttattggcctggtgtagacccgccgtgttaaccacacaaaataaggttttcttgtcccgggataacgtgtttctctaattgtacgatccttaaatttagagcaatcgcaggcgctggctcagtcaataaaggatccgggcccaacacgcacattcacagtagttcccagggcagcagaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttggccgtacttttcccctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaagaaata

SEQ ID NO: 344832 - DNA, 3221 bp, Homo sapiens
cgccccccggcccggaagtgcgcagcgctggcaagatggcgggaggggtgcgcccgctgaggggcctccgcgccttgtgtcgcgtgctgctcttcctctcgcagttctgcattctgtcgggcggtgaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttggtaggtcagagttcaaggacatttgtcaacaaaatgtttttctccaagtttattgaagggactttaaccagaaatttgcgagtcaagttacttaattagaaacatttatcagcagctctttagatgtgccaagcatcatcaataaactcaacgtactaaagtaaagcatccagaaaattgcagttctttttaaatgtaatatttgataaaataagaaaaacatttgaagtataaagcataatacacagtaattgacctttacccaaaataacaatgaaagcagcaccaataccattgcggccgcctgagtgcctgagtgcctgagtgcctgagtgcctgagtgcctgagtgcctgagtgcctgagtgcttgccttcacctggttgcctttcctcctcttccaaggtaaccacccttttgaattttttatttcacttccttttaaattttttctgtagttttattgtctatatgtaataaaataatattcaataatgcatgttttagaaccgtgtaaaatgatttcaggctgtgtgctcttctgggacttgcttatttcctaaacattgtggctctaggattcatccacgtgacttctcttcttttttttacttctgtgtaataatctattgtaagattgtatcacagtttattctccaatatatttggttaagtgctgttttccgctgttgtgactgttcaaatttctttgcctgtctcccaatggcacaggtgcaagagcttcttcagcatgtactttccagcgtgtgtcattctttaaatggctgtattgactggcattcccacccgcgctatgtaactgttcctgatgagccatattctctccaagagtggttattcttaaatttggtcgtaaagttgtctagacttcttttatattttggatattacctgtgctgtccctgaaaccctctcccagattttgattttttttttttttttgcattattgtatattttcatgaacagaactttaaaaatataattactggaagttattagagttagtccttttttgtggtggttttaagaaatctttttctaccccaggttaataaagacaatttgctacattttcttttgaaagttgtaagtataacatttcacatttaggtttagaatccacctggaattggtcctggtagatggtgtgaggtagattctactttaattgtccccccacatggatggccagttgtctcaactcttccctgttgatccgtgtgtgacctctgtcataacactcatacatgaagtgtttgtatatttctggttcttgactttctcttcttttcctattgggtgatttttatgcctcaagactacactgtcttatatactcgtaacttccccgtaggtcttgatatgtgggtgagcatttcatgttcctcacgttgtaatcctaacttagctgatttaaatattacatctatgtagatagatggtaagcgctttgtactcttcacttcaacatgtattaccgtaaagagagttgacttttcacattttaaattttgagcccatttgttacaattaagtctttctgagagtattttttataccctgtatttttctttcttttttttttttaaggtaaccgtacttttcccaaaatgctatattgcaattggactggaggctataagtggtctacggctctggctctaagtctgcaggcccaggtggggcttcatgttcagctcactgttggacttcattgacatcaccctgaaaaaggtggatttttgaggagcgtgagaagaagagcatgagaagtgctgaattacactgtgttgttgcagatgagcgtccctaaccacagcagtccttgaagaagaaagatggtctgataggaactgcttattcaggaacacattgcaaaatctgtgggtgtccttcgggatctgagggcctcactcctacaactgcaaggaattgaattcttctaacagtgtgatgaggttggaagaagactccaagatccagaaaggaacacagtcccaccaacacctgtgttgtaacctggtgacaccctgaaacagagaatccagctaagcgatgcccaaaatattcatccacaacgtgttgttttaagcttccaagtttctagtaatttgttataaagcaatagaaaagtaatatatccttatccgaggctcatcttcattccaaacgttccacatttccttctgttatcatttattttctgtcggaattacttcctccagcaaaaaaatttttaaggcagttctgctgcacttgaaaagtcttatgacacgtccttctggccttcatgatttctgctgaaaaatatgctgtcatttgaatagttttaatgcttgagatgaacccggtacctcagatggaaatgcagaaatcacccgtcttctgcgtcgctcacgctgggagctgtagactggagctgttcctattcggacatcttggctcctcccgtgctttctacatcccacatggaagcagcaatgagatgttttaaaacgagatgtttcaaaatcaccatctcactctagtttgtctacaaagccatctatcaagaacattatatgaacttttaaatacattcttctgtatttatagaatgatttttaaagcatttccagccatgtttaaaagctgtgaatagtcttttttttgtaacctagtaaccaaagttattaatgaaagtcacagttaaacttttttcctttgaaaataaaatgaatcaacacataacgagaaggtta

SEQ ID NO: 344833 - DNA, 2615 bp, Homo sapiens
cgccccccggcccggaagtgcgcagcgctggcaagatggcgggaggggtgcgcccgctgaggggcctccgcgccttgtgtcgcgtgctgctcttcctctcgcagttctgcattctgtcgggcggtgaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttggtaggtcagagttcaaggacatttgtcaacaaaatgtttttctccaagtttattgaagggactttaaccagaaatttgcgagtcaagttacttaattagaaacatttatcagcagctctttagatgtgccaagcatcatcaataaactcaacgtactaaagtaaagcatccagaaaattgcagttctttttaaatgtaatatttgataaaataagaaaaacatttgaagtataaagcataatacacagtaattgacctttacccaaaataacaatgaaagcagcaccaataccattgcggccgcctgagtgcctgagtgcctgagtgcctgagtgcctgagtgcctgagtgcctgagtgcctgagtgcttgccttcacctggttgcctttcctcctcttccaaggtaaccacccttttgaattttttatttcacttccttttaaattttttctgtagttttattgtctatatgtaataaaataatattcaataatgcatgttttagaaccgtgtaaaatgatttcaggctgtgtgctcttctgggacttgcttatttcctaaacattgtggctctaggattcatccacgtgacttctcttcttttttttacttctgtgtaataatctattgtaagattgtatcacagtttattctccaatatatttggttaagtgctgttttccgctgttgtgactgttcaaatttctttgcctgtctcccaatggcacaggtgcaagagcttcttcagcatgtactttccagcgtgtgtcattctttaaatggctgtattgactggcattcccacccgcgctatgtaactgttcctgatgagccatattctctccaagagtggttattcttaaatttggtcgtaaagttgtctagacttcttttatattttggatattacctgtgctgtccctgaaaccctctcccagattttgattttttttttttttttgcattattgtatattttcatgaacagaactttaaaaatataattactggaagttattagagttagtccttttttgtggtggttttaagaaatctttttctaccccaggttaataaagacaatttgctacattttcttttgaaagttgtaagtataacatttcacatttaggtttagaatccacctggaattggtcctggtagatggtgtgaggtagattctactttaattgtccccccacatggatggccagttgtctcaactcttccctgttgatccgtgtgtgacctctgtcataacactcatacatgaagtgtttgtatatttctggttcttgactttctcttcttttcctattgggtgatttttatgcctcaagactacactgtcttatatactcgtaacttccccgtaggtcttgatatgtgggtgagcatttcatgttcctcacgttgtaatcctaacttagctgatttaaatattacatctatgtagatagatggtaagcgctttgtactcttcacttcaacatgtattaccgtaaagagagttgacttttcacattttaaattttgagcccatttgttacaattaagtctttctgagagtattttttataccctgtatttttctttcttttttttttttaaggtaaccgtacttttcccaaaatgctatattgcaattggactggaggctataagtggtctacggctctggctctaagtctgcaggcccaggtggggcttcatgttcagctcactgttggacttcattgacatcaccctgaaaaaggtggatttttgaggagcgtgagaagaagagcatgagaagtgctgaattacactgtgttgttgcagatgagcgtccctaaccacagcagtccttgaagaagaaagatggtctgataggaactgcttattcaggaacacattgcaaaatctgtgggtgtccttcgggatctgagggcctcactcctacaactgcaaggaattgaattcttctaacagtgtgatgaggttggaagaagactccaagatccagaaaggaacacagtcccaccaacacctgtgttgtaacctggtgacaccctgaaacagagaatccagctaagcgatgcccaaaatattcatccacaacgtgttgttttaagcttccaagtttctagtaatttgttataaagcaatagaaaagta

SEQ ID NO: 344834 - DNA, 1195 bp, Homo sapiens
cgccccccggcccggaagtgcgcagcgctggcaagatggcgggaggggtgcgcccgctgaggggcctccgcgccttgtgtcgcgtgctgctcttcctctcgcagttctgcattctgtcgggcggtggtgagtcaaaggctgggttcagcgccgggtggggctgagtggcagcagggccccgggagctgcgaggaggccgggcccacgggcggacgctgacgcggggaggaggccgagtgccgggctccgggccgcttgtcgctgcatctggagtctggcgccctggccgcccggcccgaggccgcccctccgctccggcgacaccgagcccgccatcgcggctgcggagccctggcacggagatggagcgcttgggggctgggccggggaggcggaactggagcgcgatgtcatccttcggtccctcgttgccggctgacctgaactgatgtctactctgttgacgtttcgtccctaagctttgtgttttctggctgaccagccgtgaggttttcatgagcagcttattggcctggtgtagacccgccgtgttaaccacacaaaataaggttttcttgtcccgggataacgtgtttctctaattgtacgatccttaaatttagagcaatcgcaggcgctggctcagtcaataaaggatccgggcccaacacgcacattcacagtagttcccagggcagcaggtactagacgttttctattctagtaaatatatgtagttatctctagtagtttctctttgtttttataaaaattccctttagtatacgaagtcactttccatttttgaatatttattgtattttagattatgtgaattaagggtagatacacagccattttcagtagatagtcttcgtatttataccttttgacgtttctgcctcctctctttttccaatcccacgctcatttgtcaccttatttctattatttttccacttcatccatcaaaataaccttcagtccgtgcttctttcccttcagcaaatttcctctactgatggaaggattacagcgggactgatggagacttgaaatctagatctggttttgctactgggatcttgaacaaattatttatcctctttggaccttggtcctcatctttaaagcggtggggttggtctgacgacctaaagtcatttctgctttgtgattctaagtgtccaccttc

SEQ ID NO: 344835 - DNA, 412 bp, Homo sapiens
gtggaactgagaatggcatgatacgcagattcaaaaggccattaattactggcaaactgcaaatgcacgcaattaaattgcgtgactcttttatcattaggaaatgtccctctttgtccttggtaataccctttgtcctcggtaataccctttgtcctgaaatctactttatctgacatttctatagccagtccagttttcatggtattgtgtggtatgtacatctttttccatctgtttactttggtaaaagagtgactcttttatcattatgaaatgtccctctttgtccttggtaataccctttgaaggtgtaacaatccaaaatgtatgcagaaattcaaattacatgaaacaaatccctacacaactaaaaggagaaaaagaaaaatgcacagttagagtcacagaa

SEQ ID NO: 344836 - DNA, 5341 bp, Homo sapiens
caccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttggcctgtgaccctgggctgtctcgaacgtgtgaccagaacacctatctgagtggcctgtgttacctcttccgccagaatctgcagggtcccatgctgcaggggcgccctggttttcaggaatgtatcaagggcaacgtagacctggtatttctgtttgatggttcgatgagcttgcagccagatgaatttcagaaaattctggacttcatgaaggatgtgatgaagaaactcagcaacacttcgtaccagtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggggggactcggttgaattgcacgccaatgtgacctgtaacaatgaggactcagacctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtccaaaaaaaaaaaataccatttcaatactcaaaaaaaaacctgcgggggcatttatttgtggggggggccaaaacaagggtttaggcacgggggcacttgggtaaaggtgttttccggaccccagtttttgggcacacgggggataatttgcggggttcccaca

SEQ ID NO: 344837 - DNA, 443 bp, Homo sapiens
gcggatcattctctgggcctcagagactgtaaatgcaaaggaaccttaattttctaggattttagcatttggaattatttctctgcgattctgtagggaagagttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtcca

SEQ ID NO: 344838 - DNA, 569 bp, Homo sapiens
gtgcgcggtcgatctaaggatccggtgtttatcgatgccacccagatggacatttgggcctgtgaccctgggctgtctcgaacgtgtgaccagaacacctatctgagtggcctgtgttacctcttccgccagaatctgcagggtcccatgctgcaggggcgccctggttttcaggaatgtatcaagggcaacgtagacctggtatttctgtttgatggttcgatgagcttgcagccagatgaatttcagaaaattctggacttcatgaaggatgtgatgaagaaactcagcaacacttcgtaccagtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggatcgataaacaccagggggatcgataa

SEQ ID NO: 344839 - DNA, 531 bp, Homo sapiens
tgttacatgagggagcaaggtttatttcattttatttctgtgtttatttgtatattgcctcattttcaaaagaattatctgaggcaaggatgtggagttgggttgcccaggtcctgcataagaagagattgagccaggcatagtggctcacacctgtaatcccagcacattgggaggcttagccgggaggatcacttgaagccaggagttcgagaccagcctaggcaacatagcaagaccccatttctacaaaaaataaaaactagccaagtgtggtggcacgtgcctgaagtcccagctacttcggaggctgacgagggaggatggctcgagcctgggaggctgaggctgcagtgagctatgattgtgaccgtgcactccagcctgggagacagaacaagaccctgtaatcgcagctacttgggaggctgaggcatgaaaatcgctggaacccgggaggcagaggttgcagtgagccaagattgtgccagtgcactccagcctgggcaacaagagcgaaactccatctaa

SEQ ID NO: 344840 - DNA, 4931 bp, Homo sapiens
caccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttgtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggggggactcggttgaattgcacgccaatgtgacctgtaacaatgaggactcagacctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtcca

SEQ ID NO: 344841 - DNA, 5031 bp, Homo sapiens
caccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttgtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtccaaaaaaaaaaaataccatttcaatactcaaaaaaaaacctgcgggggcatttatttgtggggggggccaaaacaagggtttaggcacgggggcacttgggtaaaggtgttttccggaccccagtttttgggcacacgggggataatttgcggggttcccaca

SEQ ID NO: 344842 - DNA, 4978 bp, Homo sapiens
caccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttgtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtccaaaaaaaaaaaataccatttcaatactcaaaaaaaaacctgcgggggcatttatttgtggggggggccaaaacaagggtttaggcacgggggcacttgggtaaaggtgttttccggaccccagtttttgggcacacgggggataatttgcggggttcccaca

SEQ ID NO: 344843 - DNA, 4403 bp, Homo sapiens
tttctcaggagaaggtcttcagctgtttccatgcatctctgctactaacccaattccctggggcccctgccctctcctgctgggtgttcttccagcatcctgtgttcctaactccacgccccacacactttcctcaggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccaggtgcgcccagtccgagggcatctgcagaccagggactggcgggacacacatcacactcccttctgtcctttgaatgctcatccacttaccatgtggcagcccctgtgccaaacatgatcacatttatccctcataacacacagaggtaagccctgtcatctccctctctagtttaagaaactgaacctcaaagagcccaccttgtcttaacgcacatagactaggggtggatccaagattggaacctgcatttgagggagtggcacaagatgaacacggtacaggtatctccctgccaacccctgctgttcccacaggcgcttccccaaacacctgcctctccccacagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtccaaaaaaaaaaaataccatttcaatactcaaaaaaaaacctgcgggggcatttatttgtggggggggccaaaacaagggtttaggcacgggggcacttgggtaaaggtgttttccggaccccagtttttgggcacacgggggataatttgcggggttcccaca

SEQ ID NO: 344844 - DNA, 4005 bp, Homo sapiens
caccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttgtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccatgcgtggattgccagctggtcactccacgcttggacccgttgcccagcggccgggcagaggcgctcctcacttgccagacggtgtggcggccaggcagacgtgctcctcacttcccactctgtgtgggggccg

SEQ ID NO: 344845 - DNA, 2179 bp, Homo sapiens
  misc_feature (2084)..(2084): n is a, c, g, or t
caccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttgtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgaggtgagatgggtctcccaggtcacacctgatgaccccagctcttatcctgttttgtttatattttattttatttatttattttggtctttttttagagacagggtctctctctgttgcccaggctggagtgcagtggcatgatcataactcactgcagcctcgaactgctgggcctaagcgatcctcccacctcagcctcccaagtagctgggactacaggtctgccttcaggtcaagaaagcccccagcccagtccttggctcctactgcccccacgactgcatggccctgcccagggaaggagatgagcgggtcagctacccaccgacccaccccccagagccaactgcnctccctgcagcccattgctccagcccagcacgcacctgctgagtcgcactgatgccgctggaggacagctccatgctgatggaacgtcgcgcatg

SEQ ID NO: 344846 - DNA, 2440 bp, Homo sapiens
ggaccagccaagagggctgcaaaagtgagggcttgtcattaccagacggttcaccagcctctcttgggttccttccttggaagagaatgtctgatctaaatgtggagaaactgtagtctcaggacctagggatgttctggccctcacccctgccctgggatgtccacagatgcctccacccccctgaacctaaaataaaagttaaaaaaatgaaaaataggcccggtgtggtggctcatgcctgtaatcccagcactttgggaggccaaggagggcagatcacttgaggtcaggagttcaagaccagcctggccaacatggtgaaaccctgtctctactaaaaatacaaaaattagccgggcgtggtggcagatgcctgtaatcccagctactgaggaggctgaggcaagagaattgcttaagtctgggaggcagaggttgcagtgagccgagatcgcaccactgcactccagcctgggcaacacagtgagactccatctcaaaaaaaaaaaagtgttctcacattttcttggggccaaagtgctcagtgaattctttgctcgttcaaattttgtctttgtacaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtccaaaaaaaaaaaataccatttcaatactcaaaaaaaaacctgcgggggcatttatttgtggggggggccaaaacaagggtttaggcacgggggcacttgggtaaaggtgttttccggaccccagtttttgggcacacgggggataatttgcggggttcccaca

SEQ ID NO: 344847 - DNA, 2116 bp, Homo sapiens
gtgacgtgttaaagggagagggtctgcagctggagactccaggcgggtgatgcagtccggataggaggagatggggaatggaaccaggttcacagggactttcaggggtggaaaaggcattttccggcactcccctccccctgctcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtccaaaaaaaaaaaataccatttcaatactcaaaaaaaaacctgcgggggcatttatttgtggggggggccaaaacaagggtttaggcacgggggcacttgggtaaaggtgttttccggaccccagtttttgggcacacgggggataatttgcggggttcccaca

SEQ ID NO: 344848 - DNA, 1142 bp, Homo sapiens
  misc_feature (53)..(53): n is a, c, g, or t
ttccactttaacccaatttcccatccaatttgtccccatatcctgggccctcnccgcaggtctctgctcttgcccttcacgtccccaggcatgtcctctcctctcctcggcgtcgcagtccctgtctctcccaccttcccctgctccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtccaaaaaaaaaaaataccatttcaatactcaaaaaaaaacctgcgggggcatttatttgtggggggggccaaaacaagggtttaggcacgggggcacttgggtaaaggtgttttccggaccccagtttttgggcacacgggggataatttgcggggttcccaca

SEQ ID NO: 344849 - DNA, 680 bp, Homo sapiens
cgcagaacacactctagaggataccgcgctggagtgcgcatgcactcccatcggtgagaccaagcacgactctgtctcaaaaacaaaacaaacaaaaagaggcccgataattctgataacataaaattcttatttttctgtatagcaaagcaacccataaaaaaagtcaagaggccaggcccggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtcca

SEQ ID NO: 344850 - DNA, 882 bp, Homo sapiens
cccatgaggcagaggttgcagtgagccaagctcgtgccaatgcactccagcctgggtgacagagcaagactctgtctggaaaaagaaagaaagaggcatggccgggcgcggtggctcatgcctgtaatcccagcactttgggaggccgaggcaggcagatcacgaggttgggagatcaagaccatcctggctaacacggtgaaaccccgtctctgctaaaaatacacacacacacacacacacacacacacacaccacacacacaaaaattagccgggtgtagtggcgggtgcctgtagtcccagctactcagaaggctgaggcaggagaatggcgtgaacccgggaggcgaagcttgcagtgagccgagatcatgccatgcagtccagcctaggcgatagagcgagactccatctcaaaaaaaaaaaaaaaaagaagaaagaaagaaagaggcactgtatattctgggaatcttgataatttgatttggctggaacacagaaaaagagattgggactaggagaagatggacctggaaatgtgggatcgtgcccagtgtaagcccagataaggagtccagactcaccaccagtcctacaggcggtgagcatccattggcatagagcattggtaggatgggagggatggacagtagagactgtggaggcggacattccttgccttggtaaccagttggatagaggaagtgagaaagaggacaaggactctgaacgttcctagttttggttgatgttgccctaaagacacatagcaaataggagacccaaatctttggcctcttgctttctttaggcctgtgaccctgggctgtctcgaacgtgtgaccagaacaccgtcgaacggtaacctctagacagctag

SEQ ID NO: 344851 - DNA, 399 bp, Homo sapiens
cgcctgggccccatgaccgcaggagaagtgggtggcagaggcgcacccggctcgggggcatccccatcttggcctctgcctgagaacttggtcaccctctgccttggggccccttgggtctgctcctctctctggagcctctaacttctcatccttccttttttgcagagaggccaaacgggaagttgtatcctcaggccctgggaagagctttcagagctctaggggggccgggagttgctccttccatattcccagaagtcaacgccctggagcggaagcgcagggtgcgggtggcctggggagcgacatccgggtgggcctgggatcggccacctgctgggcacgtgcaggggcgggggtccctcggtcgcagctgacgacccttgccttcctcag

SEQ ID NO: 344852 - DNA, 5092 bp, Homo sapiens
caccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttgtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggggggactcggttgaattgcacgccaatgtgacctgtaacaatgaggactcagacctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtccaaaaaaaaaaaataccatttcaatactcaaaaaaaaacctgcgggggcatttatttgtggggggggccaaaacaagggtttaggcacgggggcacttgggtaaaggtgttttccggaccccagtttttgggcacacgggggataatttgcggggttcccaca

SEQ ID NO: 344853 - DNA, 4965 bp, Homo sapiens
  misc_feature (4886)..(4886): n is a, c, g, or t
caccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttgtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggggggactcggttgaattgcacgccaatgtgacctgtaacaatgaggactcagacctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccacanaaggcaccaagtaacaggcggggtgtagtttatgccgcataaaatgtgattttccgacccgcgggttgtggattctgcg

SEQ ID NO: 344854 - DNA, 5000 bp, Homo sapiens
caccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttgtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtccaaaaaaaaaaaataccatttcaatactcaaaaaaaaacctgcgggggcatttatttgtggggggggccaaaacaagggtttaggcacgggggcacttgggtaaaggtgttttccggaccccagtttttgggcacacgggggataatttgcggggttcccaca

SEQ ID NO: 344855 - DNA, 5616 bp, Homo sapiens
cccatgaggcagaggttgcagtgagccaagctcgtgccaatgcactccagcctgggtgacagagcaagactctgtctggaaaaagaaagaaagaggcatggccgggcgcggtggctcatgcctgtaatcccagcactttgggaggccgaggcaggcagatcacgaggttgggagatcaagaccatcctggctaacacggtgaaaccccgtctctgctaaaaatacacacacacacacacacacacacacacacaccacacacacaaaaattagccgggtgtagtggcgggtgcctgtagtcccagctactcagaaggctgaggcaggagaatggcgtgaacccgggaggcgaagcttgcagtgagccgagatcatgccatgcagtccagcctaggcgatagagcgagactccatctcaaaaaaaaaaaaaaaaagaagaaagaaagaaagaggcactgtatattctgggaatcttgataatttgatttggctggaacacagaaaaagagattgggactaggagaagatggacctggaaatgtgggatcgtgcccagtgtaagcccagataaggagtccagactcaccaccagtcctacaggcggtgagcatccattggcatagagcattggtaggatgggagggatggacagtagagactgtggaggcggacattccttgccttggtaaccagttggatagaggaagtgagaaagaggacaaggactctgaacgttcctagttttggttgatgttgccctaaagacacatagcaaataggagacccaaatctttggcctcttgctttctttaggcctgtgaccctgggctgtctcgaacgtgtgaccagaacacctatctgagtggcctgtgttacctcttccgccagaatctgcagggtcccatgctgcaggggcgccctggttttcaggaatgtatcaagggcaacgtagacctggtatttctgtttgatggttcgatgagcttgcagccagatgaatttcagaaaattctggacttcatgaaggatgtgatgaagaaactcagcaacacttcgtaccagtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtccaaaaaaaaaaaataccatttcaatactcaaaaaaaaacctgcgggggcatttatttgtggggggggccaaaacaagggtttaggcacgggggcacttgggtaaaggtgttttccggaccccagtttttgggcacacgggggataatttgcggggttcccaca

SEQ ID NO: 344856 - DNA, 2587 bp, Homo sapiens
caccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttgtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcggtaagaagagatggctagggatggtggggagtttatcagagaaatccatttggcaagaagagccgcccatggccgggcagcacactcctataatcccagcactttgggaggctgaagtgggtggatcacttaaggtcaggggttcaggaccagcctggccaacatggtgaaaccccatctctactaaaaatacaaagattagtcgggtgtgatggtgcacttgaggccaggagtttgagaccagcctgggcaacatagtgggactccctttctacaaaacataaaaaattagttattgtgatggtgcgcccctgtagtcccagctacttgggaggctgagcagggaggatcacttgagccagagggttgaggctgcagtgagctattgagctatgattgcaccactgccctccagcctaggcaacagcacgaaaccctgtctctaaagaag

SEQ ID NO: 344857 - DNA, 2830 bp, Homo sapiens
ccagatctctcagatcttagcccagcctggtcttaaccacacacgctctacacagcccaccttttcagcctcattcttttatcactccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggggggactcggttgaattgcacgccaatgtgacctgtaacaatgaggactcagacctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtccaaaaaaaaaaaataccatttcaatactcaaaaaaaaacctgcgggggcatttatttgtggggggggccaaaacaagggtttaggcacgggggcacttgggtaaaggtgttttccggaccccagtttttgggcacacgggggataatttgcggggttcccaca

SEQ ID NO: 344858 - DNA, 279 bp, Homo sapiens
cctcgttctcccgggttctgacgcctttccccgctcccacaggcctcttccatgttcagcctctgcagctccctctccatctccttcaacagcagcaagcatttccacctctatggcagcaacgcctccctggcccaggtatctccacctccttggaagccccaggaacaggcaacagagggagcccaggagccccagggcagacctagatgtgggagagctcctgggctctgtgcgagtcagaacttcccactgccagagccatcagcctgggagaag

SEQ ID NO: 344859 - DNA, 371 bp, Homo sapiens
cttcagaccaaacacatcatgactcaacaacaaaagaagggtaagaagaattctagctgaggcatatccaaagctttggcccagtggattcaggcatggcccaaaccttttggagcggagtggcggctgccgtgtcatgagaggcagtggaaaatatgacaacagaagagaaggcactgtgaccatggaggcagccacaagccatgggatgctggcagctaccagaagctgggagaagcaaggaatagattttcccctgtaacctttggaagaaatgtggtcctgttgacattctgattttggcccagtgaaactgatttcaaaccttcctccagaactgtgaaagaataaatttctgtgttttaagctgc

SEQ ID NO: 344860 - DNA, 690 bp, Homo sapiens
ccagctcaaatatcccttgatttgggtagtaaaatcgtccttatttttatatcaacgatatattgagcaaaacatttgaactgttcaaaatttctgtttccttaaattgtcttacatctcatctcagattaactgtatgtatacatattccaacccaaaggcttgactttctcagactggagtgatagctagcaggttaatttactccggttcctccaaatgaaaaaccatgaaccatattcatggctatgaaaacatgatttaaacttgcagtacaggaagaaatacttaccttttggggtagatgtaaacagccagtcccctcctttatcatgttccttttctttgtattatttactttcagtgatctgggactataattcttcataaaagttcatccacggtctgcatttcctttcctttttacatccttctagaaagttacatagcaagatcttgtttccttaaaaatattgtacttatgttattaatatttgatagtaaaaataatacatgctcattgtaaaaacttagaaaatacagcaatgctaccattgagaaataagtcacaattaacatatttttggatgtttatgtgggaatatattttaacaaagctgtatgtatatgcatgtatgtgtgtataatagtgcttgtatatctataaagaaaccttgaaattatatacat

SEQ ID NO: 344861 - DNA, 1289 bp, Homo sapiens
tgtaaagttctcctgtgtctccttctatttgttcagcatttctgaatctacacagagctcctgccttgatctaaaatctatgccactttgagtcactttttagcactggatatctataatgacatagccataactgatgtattatctaggacttgggacagtccgaaggaatttggaaagcctaaataccttgacgtgtctaaaccaaatttctacctattttccactgaatagttgtggcctggggctagatagtggctttaaaacaggacaggtctttgcctgaagtccattcatctttttattcctgtttttatttgtccttaattattgatctaagaaaacaaataataagcacaacttttcctaaatatcctccagacattgtgcatcctccttgttgcagcttttaatctatgcctgttactgctacttctctaacctaaatgtgcacagagatcactggaaggatcttgttacaggtctaaaaagcgcccaggtgatcagcatgctgctggccctatgatgataagtagtgggctcttccttagccttctctctggttcctcctcgtatcaaaggaaggtggttcccagagtagctgaatgagaagtgaggcgtgactctcgctgtgcctgcagccgtctcataaatggccaatggtgtagttttaggtgcttagatccaatccctggtgacaagccattttgtggctcttctgtcacacgtctgtgattctgttttccagagagcaagccagagtgacccacccagaaggtaactgttttgtagcctctccaagttttctctctgaggttatgaaatagatgcagagatagctcctcacagaagtgcaggattccccagtgtgttaaatcttaattttaactttgtatatgagacgtcctctcaccttattactttcagcatatattaatgcaattgtttcttttaaagtaaatgagtgccttactcactggagaaccatcctagccctagcagtttgtcacatgcaagttcatcttccttctcgaccttggattcacagtgctacaagctgagtgtatactgcaaatcaagaaacaactgtttttctgttgagaaatgctaaagacatttttctctctctcctctcacaaagaaaaagactgcactgattgttactttaacacattaaagtcttgagaattagcactcactcatttgaaccattagtggatacttacaggaaacttgcataagagccataaggatacttacaaaaaacttgcctggggcaagttgtgatt

SEQ ID NO: 344862 - DNA, 459 bp, Homo sapiens
agaaggtgtatttctctgccagccaccttcttgggagaccactggtcagcgagggcttgacatggtaccaagtgggttggggctggggccaaagagaggcctcctgggaagctgttgatgacattctggggcctggagggaggaaaatcactcagggaggggccaggcccctcaaccactctgttcttgtttgccctctcctcataacccttggcttgggtctcggaagcttcagcttaaaggctggagatgaaaaaggccaaaggtcagtagggtcggtggcttcaggctactgagggacctgtgatccccagcaggagacctgaagagccagagcagctcagggatggaaacagccccatttggcactcttagcatttgaagagccctgcccagcctcatggaaccttccatcgacaagggcacaggggcagatttggactataacgcaggtccttg

SEQ ID NO: 344863 - DNA, 611 bp, Homo sapiens
aattcaagttaagtcagggtaatacttatttgaacttaattgtctgtacagagatatttaaaatttagcccaaatattctccactaagtcttcaaataaagattaattaaaagtcctaaagctatctaaacataaatcaataagtagtaaatgttaaaaataaagagacaaagttgcttttctctcttgctaggagaaaaagagaaggtgaagcatgaaagtcatgctttcattttaaaagtatgtgcagagtgagtagatggcacttttatttcaactaaatcatgtgtatttagtgtctgtgtatcttactggtgtgttcattttcatttttcaatccactgtatctcaagtgatcagataattcatcatccaagtcaatttcattttagaacgtgaaaaggggcactggaaacattttttttggacggggggacaagagatacaaccatgaacatctccaagcaaatcagaataaatgatcacttaacattgaccccaaaaatctgctgctctagtatttttgtcggttccttctcttttactccatcaatgcaccaggtgtagttctggctaattttctggtttataatgtcaatttcagattcagg

SEQ ID NO: 344864 - DNA, 297 bp, Homo sapiens
ggccttaagactggttggatgactgatttaagcctccattgagctttattttcgcacctgtttaatgggaaaataataaaagcttagatttattgagcactccctgtatatttgaagcatggtgctaagcatttaatacatattttgtcatttaattctcattaaaccaaatgagatagggataattatttggcccattttacagataaggaaaccaaggttcacctgtaagtcactcactcagagaggctaagtgacttgtccaagtttacataaccaggaaatgggaagtaagga

SEQ ID NO: 344865 - DNA, 1150 bp, Homo sapiens
tgagacctctgagtcaccccccaggccgacctcagataaactcccattcatttcttctctctggcctggaggaggccaagccaagttgcagttcaggctctggggagcagcggggccccccagtgaacctctcaccgtttggtagagggtggcactctgggggctcctctgtactttcctaaatggtaaagttaatctcacttcctctttcgtaagaagagaaaacggggcgggagtgctttggctcaacacatcaggctgttggaagttcctttaaagccatagttttctctgagtactttctggcctttaccaacccctcggaaactcacggtaattcacgtctgtacttgcagtcatgcagcacctatgcagtgctggtgtgaaccatgtgttgagagaagggaggaaaaccaacattcattagatagttaatggcgttccaggccggatgctgctcctgcgtcgtctcacccgcaagacatggattggctcttctccccattctgcagatgcagaaaatcgagtcccaaactggggaactaacttataagtgatagagaggagccaggattttggatgctggccttcctgctgggtggcttctagggaagaagctcaatgacttaatcaggatgatttagtccaagctggagagggagtgagagaggcccctttctggccttgggtggaggactgtagaagagttctttctctgggcagaaggttttgatgaagtcacaggcatttctctgaaagcctgctgagggtggaaatactgacagccccttggtcctcaccagtaacaacacatgagaggtgatgtggctcctgtgagagccccccatctgggctgctgagctctggagcccccagagctggaatattcctccctgcatcttcctggtgccctttgcgacagatggagagggggtgtgcgagaggaagggagtctaaaagtgttgtacggatcccacacgcgctcgcttgctgcttccaatggctccgtgcgacaggttattttcttatttgtagtcttggactgacggaaggtttcccccctctctctctctttttaaatgtgctcagatttctggcctgtcaacacaactcagatcatgtcactccccagctcaaaactgttgagtgg

SEQ ID NO: 344866 - DNA, 263 bp, Homo sapiens
ttttagtagagatggggtttttaccatgttagccaggatggtctcgatctcccgaccttgtgatccgcccacctcggcctcccaaagtgctgggattacaggcgtgagccaccatgcctggccagtattcagttttaataccgcttcctgtacaaagcacagtccaatattccccagacaaaactgtgtgctacacaatgtattacaatagctccccacaaaagcatgttccaattcaaattatactgcatatcgatatatac

SEQ ID NO: 344867 - DNA, 225 bp, Homo sapiens
ttatgtcttagtatcttatgggtaatacttaggcttttgagtagcatgtataacagtatgaattctcctgtagtacaactactttgaaaaagcgggtgagccttataaaatacagacatgacccagtgattcccattctagaaaaatgcatgtgtatatgcttctgaagacttttataaataagtgttcataacagcattatttttgtagtagattggaaaagta

SEQ ID NO: 344868 - DNA, 465 bp, Homo sapiens
agctggttagtgctaactggcaggggcaccagagtaaaatgggccttctggaaggctggaaagctggaggaagaggtgttttcctggaaagccagggattaattctgatttcttttccctctaaattagagtggggacttgctgaagttgagtttaagtgaaggtcaaaaagagaacaagttttgtaagaattccttaaatgcctgggtttgatgatcagtgcacattcctcaggaattattatagcaggtcaataagaacatagccagtaatgaacctttcagatccagcaaggactcacatttcatgcacagtttcaccagcagttgcatgacccctatcaaggaccccagcagccaagggaagtgactcaaatatgtggttcatctgctcttaccctgggcagccactctagttcttatacagttatgtatcttttgctaattaaaccaggaacctaattta

SEQ ID NO: 344869 - DNA, 676 bp, Homo sapiens
agctggttagtgctaactggcaggggcaccagagtaaaatgggccttctggaaggctggaaagctggaggaagaggtgttttcctggaaagccagggattaattctgatttcttttccctctaaattagagtggggacttgctgaagttgagtttaagtgaaggtcaaaaagagaacaagttttgtaagaattccttaaatgcctgggtttgatgatcagtgcacattcctcaggaattattatagcaggtcaataagaacatagccagtaatgaacctttcagatccagcaaggactcacatttcatgcacagtttcaccagcagttgcatgacccctatcaaggaccccagcagccaagggaagtgactcaaatatgtggttcatctgctcttaccctgggcagccactctagttcttatacagttatgtatcttttgctaattaaaccaggaacctaatttaatatttttgctttgtgtgtaagatttcttcatgtccatctataatccatctgagatacaactggcataaagatgggttctgaaatgctgtagttcgtgtcagaagtagattcataagccaaattactatcatggtttgattttagaaatggtgtcaggaaaacaagaaatgaaatggtgagataaagaagtgtgagaggaaactccgccca

SEQ ID NO: 344870 - DNA, 92 bp, Homo sapiens
tgagtgtcccctccccaacccagaacaagttttaatctcttaatcttcctcattaatcactcaccctcctacccctctctgtggatccgatt

SEQ ID NO: 344871 - DNA, 380 bp, Homo sapiens
ctggctgctggcaactcagatgttcaaactgtcacgaacatttatcaagctgtgtgaagcctgctccccttcaccttctgccaagattggaagctctctgagggcctcacaagaagcagatactggtgccatgcttcttgtacagcctgcagaactgtgaggcaaataagcctcttcttggtataaattacctgcctcaggcattcctttatagcaaagcaaatggacgaagacagaggactctggttgagagctccgattctccatcttcacacttctcagggaagaggcaagagctgccctgtccaatggggtaactgctacctacatgttgctatttacattcaaaataactaaaattaaatacagtttaaactcta

SEQ ID NO: 344872 - DNA, 950 bp, Homo sapiens
cctgctttctgcctcgtagtccaaaatgttgatggttagaagaaaatgaggcaggaaccagtcagtttaatatggatctttttcttttctgtttttttttgttgttgtcattgttgttgtttttgagacagagtctcactctgttgcccaggttggtcacagatgtcggctgtttgaagatgctggggaatgcaccccggacctcacacaggatctttttcaagtctgagatgatatggacccattgtaacaatcttctgaattagctctgacctcacttctagtaattttgagtcattgttctgtttcttgaatatgaatagttggtggttgtggtttttgtttttaacttattcaatattggctctctcaaatcctaattatcctaccagttggctctccggtattatcttaatacctggtaccatcccaattttgtggatgagaaaacaagtgtttaaagtgtcgcactgaatgttgggcgcagtggttcatgcctgtgatcccagcatttggtagggacctaaacaggaggattacttgaggccaggagtttcagaccagcttgagcaacatagcaagacctcgtctctactataaagcaaaaaaaaagttagccaggtgtggcagtgtgcacctgcggtggtggtcccagctacttgggagtctgaggtgggaggcctgcttgagctagggaggtcgaggctgcactgagccatgattaggccactggactccagcctgggtgacaaagcaaaaccctatctcaaaaaaataaaaataaagtatcacactcacggtagcagtgattgtagattcccagtcctgatgatacctccaagccacgctcagtggctcatggagctattttggttggtacttgagagcaatcccattttgagaacttggagagtggggtttctttcatttaccttctgtggaatgagcct

SEQ ID NO: 344873 - DNA, 349 bp, Homo sapiens
atgttttttggacttacgtatttctttttattcaagaactctatccaatatatacacattttccttttggcttttgtcatttgtgtctttaagactttgaataatgtttttaaataatattaactttaatctttcatacacctttcagaaatttactatttgtattttgttttgtgtattttgtaacacacaagttgtaaatgattatgtattttctgttcaattccatctttcatttttatgcttaaaaatgtcttcttagtcatatatgcccggagtcactgctccgtggagggggtgagtggggtgaggggctatggatggggcgcccgtttggcacgggggaagt

SEQ ID NO: 344874 - DNA, 3393 bp, Homo sapiens
atgttttttggacttacgtatttctttttattcaagaactctatccaatatatacacattttccttttggcttttgtcatttgtgtctttaagactttgaataatgtttttaaataatattaactttaatctttcatacacctttcagaaatttactatttgtattttgttttgtgtattttgtaacacacaagttgtaaatgattatgtattttctgttcaattccatctttcatttttatgcttaaaaatgtcttcttagtcatatatgcccgtctacattttcttctagttcttttattagatatatctagtattaattcgtcacccatttgatacatggtaatttttttcatgatgtggacatgaagtaaatattctgatttttaaatgtttccattataattggctaccattgtcaattttcttattggttctgatacttattcggtttcttagttttccaggtaataatttatctgcaagtcagcgtaacttaattatttgttttttaatagttcagtattaccattgcctttgttgtttcattgagaacttccagtacaatgtcaggagggggaaaaaaacaacggcaatggcaccaatccttctcttgttgttcatctttatattccttagaacatacggaatgcgttctgacatagaacttattgaagagtaatttggaattttctgatgaatcaactgtctttaatctttacaagtttgaaaggtatacgttattgtttccatttcccagatggagaaattgaggttcaggaaggttacacaaagtcccaggtctaagaaaaatgtctcccagattcccaaaagatgtttctattatgctaatagtgcccgttcaagcattagaggaaaggttgcccgtggtatcgctggtaaattcttcttcccactttcaaatctagaatagtaaaacagccaaaatcccaacaggcatgagagttatcgcagtagataggttaagctgcttctctgctgtggtcaacgtcagctctgttgcgaggcgggttctcccaacaatagcccacaccatttccaggcttttctgggcgaggggcagggcgcccggcccccaaagcgagaagacagacagccccggttctccgcagccccaggtttgctcctcaaggacggaggggcctctcagctccggccgcctcctttccgccccctgcaggccggccggaggaaagctcagggcccaggtcggcccagggagcacggaaccaaagagcgctagcgccggttcggccgcctttccagaaagcccgggccgaacggccccgccgcagagactcagcgcggatcgctgctccctctcgccatggcgcaggtgctgatcgtgggcgccgggatgacaggaagcttgtgcgctgcgctgctgaggaggcagacgtccggtcccttgtaccttgctgtgtgggacaaggctgaggactcagggggaagaatgactacagcctgcagtcctcataatcctcagtgcacagctgacttgggtgctcagtacatcacctgcactcctcattatgccaaaaaacaccaacgtttttatgatgaactgttagcctatggcgttttgaggcctctaagctcgcctattgaaggaatggtgatgaaagaaggagactgtaactttgtggcacctcaaggaatttcttcaattattaagcattacttgaaagaatcaggtgcagaagtctacttcagacatcgtgtgacacagatcaacctaagagatgacaaatgggaagtatccaaacaaacaggctcccctgagcagtttgatcttattgttctcacaatgccagttcctgagattctgcagcttcaaggtgacatcaccaccttaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggtaccaagtgctggtgtgattctaggatgtgcgaagagcccctggatgatggcgattggatttcccatctgacttcctggaaattggagcacacagtcaggttttatttgatttttttttttaaggataccacttcacagcctttaggatagctattatttagaagcaaaacagaagataaatgttggcaaggatgtggagatattggattcccttgtgcagtgccggtgggaatgtaaaatgatgtagctactatggaaaatgatacggcaatttctttagaaatgaaatatagaattgccgtatgatctgcagttccacatctggatatctatccaaaagaagtgaaagtagggacttgaacgaacatttgtacaccaatgttcacagcggctttattcacaacagccaaaaggtggaagcaacccagtgtccatggatagatgaatagataaataaaatgtggtataaacatacaatgggctattgtttagccttaaaagggaaggaaattctgacatgctgcaatatggatgaagcttaaagtcattatgcaaagtggaataagcctatcacaaaaaataatattacataattctacttatatgaggaatctagagcagtcagtttcacagagacagaaaatagaatggtggttgccaagggctgggagaagagggcaatggagagtgagtgtttagtgggtcagagttttagtttgggaaggtaaaaagttctggagatggatgatggttatgggtgctcaacagtgtgaatgtacttaatgccacagaactgcacatttaaatgtggttaaaatcatcacttttatgttatgtatatttaccacaataaataaagaagttgatatttcttatacttacaaagaggagaagggcatttgcaaatcaacaagaagtgtgaggcccctctctctagcagaaaaatagactaaatctatttctttatcttttaacatcctgtttaagggaaatgccaaaacaaatgggaaaaaatacacacacacaaatatatatgaacatgttttgcctcatgagtaatcaaaatgtgtacatatgtatgtttatgtatgtgtgtttatatttaaaatcgtgttctgccttatgagtaaacaaaaagtatacaaattaaaaactataatgaaacgt

SEQ ID NO: 344875 - DNA, 2611 bp, Homo sapiens
atgttttttggacttacgtatttctttttattcaagaactctatccaatatatacacattttccttttggcttttgtcatttgtgtctttaagactttgaataatgtttttaaataatattaactttaatctttcatacacctttcagaaatttactatttgtattttgttttgtgtattttgtaacacacaagttgtaaatgattatgtattttctgttcaattccatctttcatttttatgcttaaaaatgtcttcttagtcatatatgcccgtctacattttcttctagttcttttattagatatatctagtattaattcgtcacccatttgatacatggtaatttttttcatgatgtggacatgaagtaaatattctgatttttaaatgtttccattataattggctaccattgtcaattttcttattggttctgatacttattcggtttcttagttttccaggtaataatttatctgcaagtcagcgtaacttaattatttgttttttaatagttcagtattaccattgcctttgttgtttcattgagaacttccagtacaatgtcaggagggggaaaaaaacaacggcaatggcaccaatccttctcttgttgttcatctttatattccttagaacatacggaatgcgttctgacatagaacttattgaagagtaatttggaattttctgatgaatcaactgtctttaatctttacaagtttgaaaggtatacgttattgtttccatttcccagatggagaaattgaggttcaggaaggttacacaaagtcccaggtctaagaaaaatgtctcccagattcccaaaagatgtttctattatgctaatagtgcccgttcaagcattagaggaaaggttgcccgtggtatcgctggtaaattcttcttcccactttcaaatctagaatagtaaaacagccaaaatcccaacaggcatgagagttatcgcagtagataggttaagctgcttctctgctgtggtcaacgtcagctctgttgcgaggcgggttctcccaacaatagcccacaccatttccaggcttttctgggcgaggggcagggcgcccggcccccaaagcgagaagacagacagccccggttctccgcagccccaggtttgctcctcaaggacggaggggcctctcagctccggccgcctcctttccgccccctgcaggccggccggaggaaagctcagggcccaggtcggcccagggagcacggaaccaaagagcgctagcgccggttcggccgcctttccagaaagcccgggccgaacggccccgccgcagagactcagcgcggatcgctgctccctctcgccatggcgcaggtgctgatcgtgggcgccgggatgacaggaagcttgtgcgctgcgctgctgaggaggcagacgtccggtcccttgtaccttgctgtgtgggacaaggctgaggactcagggggaagaatgactacagcctgcagtcctcataatcctcagtgcacagctgacttgggtgctcagtacatcacctgcactcctcattatgccaaaaaacaccaacgtttttatgatgaactgttagcctatggcgttttgaggcctctaagctcgcctattgaaggaatggtgatgaaagaaggagactgtaactttgtggcacctcaaggaatttcttcaattattaagcattacttgaaagaatcagtaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggttacaaatgctgctgccaactgtcctggccaaatgactctgcatcacaaacctttccttgcatgtggaggggatggatttactcagtccaactttgatggctgcatcacttctgccctatgtgttctggaagctttaaagaattatatttagtgcctatatccttattctctacatgtgtattgggtttttattttcacaattttctgttattgattattttgttttctattttgctaagaaaaattactggaaaattgttcttcacttattatcatttttcatgtggagtataaaatcaattttgtaattttgatagttacaacccatgctagaatggaaattcctcacaccttgcaccttccctacttttctgaattgctatgactactccttgttggaggaaaagtggtacttaaaaaataacaaacgactctctcaaaaaaattacattaaatcacaataacagtttgtgtgccaaaaacttgattatccttatgaaaatttcaattctgaataaagaataatcacattatcaaagcccca

SEQ ID NO: 344876 - DNA, 3133 bp, Homo sapiens
atgttttttggacttacgtatttctttttattcaagaactctatccaatatatacacattttccttttggcttttgtcatttgtgtctttaagactttgaataatgtttttaaataatattaactttaatctttcatacacctttcagaaatttactatttgtattttgttttgtgtattttgtaacacacaagttgtaaatgattatgtattttctgttcaattccatctttcatttttatgcttaaaaatgtcttcttagtcatatatgcccgtctacattttcttctagttcttttattagatatatctagtattaattcgtcacccatttgatacatggtaatttttttcatgatgtggacatgaagtaaatattctgatttttaaatgtttccattataattggctaccattgtcaattttcttattggttctgatacttattcggtttcttagttttccaggtaataatttatctgcaagtcagcgtaacttaattatttgttttttaatagttcagtattaccattgcctttgttgtttcattgagaacttccagtacaatgtcaggagggggaaaaaaacaacggcaatggcaccaatccttctcttgttgttcatctttatattccttagaacatacggaatgcgttctgacatagaacttattgaagagtaatttggaattttctgatgaatcaactgtctttaatctttacaagtttgaaaggtatacgttattgtttccatttcccagatggagaaattgaggttcaggaaggttacacaaagtcccaggtctaagaaaaatgtctcccagattcccaaaagatgtttctattatgctaatagtgcccgttcaagcattagaggaaaggttgcccgtggtatcgctggtaaattcttcttcccactttcaaatctagaatagtaaaacagccaaaatcccaacaggcatgagagttatcgcagtagataggttaagctgcttctctgctgtggtcaacgtcagctctgttgcgaggcgggttctcccaacaatagcccacaccatttccaggcttttctgggcgaggggcagggcgcccggcccccaaagcgagaagacagacagccccggttctccgcagccccaggtttgctcctcaaggacggaggggcctctcagctccggccgcctcctttccgccccctgcaggccggccggaggaaagctcagggcccaggtcggcccagggagcacggaaccaaagagcgctagcgccggttcggccgcctttccagaaagcccgggccgaacggccccgccgcagagactcagcgcggatcgctgctccctctcgccatggcgcaggtgctgatcgtgggcgccgggatgacaggaagcttgtgcgctgcgctgctgaggaggcagacgtccggtcccttgtaccttgctgtgtgggacaaggctgaggactcagggggaagaatgactacagcctgcagtcctcataatcctcagtgcacagctgacttgggtgctcagtacatcacctgcactcctcattatgccaaaaaacaccaacgtttttatgatgaactgttagcctatggcgttttgaggcctctaagctcgcctattgaaggaatggtgatgaaagaaggagactgtaactttgtggcacctcaaggaatttcttcaattattaagcattacttgaaagaatcaggtgcagaagtctacttcagacatcgtgtgacacagatcaacctaagagatgacaaatgggaagtatccaaacaaacaggctcccctgagcagtttgatcttattgttctcacaatgccagttcctgagattctgcagcttcaaggtgacatcaccaccttaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggttacaaatgctgctgccaactgtcctggccaaatgactctgcatcacaaacctttccttgcatgtggaggggatggatttactcagtccaactttgatggctgcatcacttctgccctatgtgttctggaagctttaaagaattatatttagtgcctatatccttattctctacatgtgtattgggtttttattttcacaattttctgttattgattattttgttttctattttgctaagaaaaattactggaaaattgttcttcacttattatcatttttcatgtggagtataaaatcaattttgtaattttgatagttacaacccatgctagaatggaaattcctcacaccttgcaccttccctacttttctgaattgctatgactactccttgttggaggaaaagtggtacttaaaaaataacaaacgactctctcaaaaaaattacattaaatcacaataacagtttgtgtgccaaaaacttgattatccttatgaaaatttcaattctgaataaagaataatcacattatcaaagccccaaaaaaaaaaaaaaaaaaaaaaaaacataaaaacaaggaggaacacaacaaaaaagacacctaaaataaagaggaggggggacgcaccgtaaaaaaattgacccccggggggcccccaccatgaaaaagcgcaccaaccaagctagtttgggaaaacagagagggaggcaccaatagaaggagcgagcgacacaaaaaccgccgcagcgggcaggcagccgccgaaaaaaaacgcggccgacgggagagaaaacgaagctcagctggccagatcgcttgagaagaacgcccaacactcgcgggggggggacaaaaaatggaggaacaaacacccacaaggaaaagccacccggaggaacatagt

SEQ ID NO: 344877 - DNA, 1336 bp, Homo sapiens
agcgttttccaacagtatagatctcatgaatcaaatcctccatgcagatgatgccgtatttaccaagagatcgagcaatcaaagcgttatctgtcaaagcaattcgcttcttattgattatgccaaaaaacaccaacgtttttatgatgaactgttagcctatggcgttttgaggcctctaagctcgcctattgaaggaatggtgatgaaagaaggagactgtaactttgtggcacctcaaggaatttcttcaattattaagcattacttgaaagaatcaggtgcagaagtctacttcagacatcgtgtgacacagatcaacctaagagatgacaaatgggaagtatccaaacaaacaggctcccctgagcagtttgatcttattgttctcacaatgccagttcctgagattctgcagcttcaaggtgacatcaccaccttaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggttacaaatgctgctgccaactgtcctggccaaatgactctgcatcacaaacctttccttgcatgtggaggggatggatttactcagtccaactttgatggctgcatcacttctgccctatgtgttctggaagctttaaagaattatatttagtgcctatatccttattctctacatgtgtattgggtttttattttcacaattttctgttattgattattttgttttctattttgctaagaaaaattactggaaaattgttcttcacttattatcatttttcatgtggagtataaaatcaattttgtaattttgatagttacaacccatgctagaatggaaattcctcacaccttgcaccttccctacttttctgaattgctatgactactccttgttggaggaaaagtggtacttaaaaaataacaaacgactctctcaaaaaaattacattaaatcacaataacagtttgtgtgccaaaaacttgattatccttatgaaaatttcaattctgaataaagaataatcacattatcaaagcccca

SEQ ID NO: 344878 - DNA, 1613 bp, Homo sapiens
atgttttttggacttacgtatttctttttattcaagaactctatccaatatatacacattttccttttggcttttgtcatttgtgtctttaagactttgaataatgtttttaaataatattaactttaatctttcatacacctttcagaaatttactatttgtattttgttttgtgtattttgtaacacacaagttgtaaatgattatgtattttctgttcaattccatctttcatttttatgcttaaaaatgtcttcttagtcatatatgcccgtctacattttcttctagttcttttattagatatatctagtattaattcgtcacccatttgatacatggtaatttttttcatgatgtggacatgaagtaaatattctgatttttaaatgtttccattataattggctaccattgtcaattttcttattggttctgatacttattcggtttcttagttttccaggtaataatttatctgcaagtcagcgtaacttaattatttgttttttaatagttcagtattaccattgcctttgttgtttcattgagaacttccagtacaatgtcaggagggggaaaaaaacaacggcaatggcaccaatccttctcttgttgttcatctttatattccttagaacatacggaatgcgttctgacatagaacttattgaagagtaatttggaattttctgatgaatcaactgtctttaatctttacaagtttgaaaggtatacgttattgtttccatttcccagatggagaaattgaggttcaggaaggttacacaaagtcccaggtctaagaaaaatgtctcccagattcccaaaagatgtttctattatgctaatagtgcccgttcaagcattagaggaaaggttgcccgtggtatcgctggtaaattcttcttcccactttcaaatctagaatagtaaaacagccaaaatcccaacaggcatgagagttatcgcagtagataggttaagctgcttctctgctgtggtcaacgtcagctctgttgcgaggcgggttctcccaacaatagcccacaccatttccaggcttttctgggcgaggggcagggcgcccggcccccaaagcgagaagacagacagccccggttctccgcagccccaggtttgctcctcaaggacggaggggcctctcagctccggccgcctcctttccgccccctgcaggccggccggaggaaagctcagggcccaggtcggcccagggagcacggaaccaaagagcgctagcgccggttcggccgcctttccagaaagcccgggccgaacggccccgccgcagagactcagcgcggatcgctgctccctctcgccatggcgcaggtgctgatcgtgggcgccgggatgacaggaagcttgtgcgctgcgctgctgaggaggcagacgtccggtcccttgtaccttgctgtgtgggacaaggctgaggactcaggtgggttgtctaaacgccaaaacctgggaaaagaggactgccgggcaggctgctgaggtggtgtgggcctgcacccaagaaagtctaaggcgaaaacgctataccctcagctccctgagcggccgtgtagcgcggcccatgcgccga

SEQ ID NO: 344879 - DNA, 2770 bp, Homo sapiens
atgttttttggacttacgtatttctttttattcaagaactctatccaatatatacacattttccttttggcttttgtcatttgtgtctttaagactttgaataatgtttttaaataatattaactttaatctttcatacacctttcagaaatttactatttgtattttgttttgtgtattttgtaacacacaagttgtaaatgattatgtattttctgttcaattccatctttcatttttatgcttaaaaatgtcttcttagtcatatatgcccgtctacattttcttctagttcttttattagatatatctagtattaattcgtcacccatttgatacatggtaatttttttcatgatgtggacatgaagtaaatattctgatttttaaatgtttccattataattggctaccattgtcaattttcttattggttctgatacttattcggtttcttagttttccaggtaataatttatctgcaagtcagcgtaacttaattatttgttttttaatagttcagtattaccattgcctttgttgtttcattgagaacttccagtacaatgtcaggagggggaaaaaaacaacggcaatggcaccaatccttctcttgttgttcatctttatattccttagaacatacggaatgcgttctgacatagaacttattgaagagtaatttggaattttctgatgaatcaactgtctttaatctttacaagtttgaaaggtatacgttattgtttccatttcccagatggagaaattgaggttcaggaaggttacacaaagtcccaggtctaagaaaaatgtctcccagattcccaaaagatgtttctattatgctaatagtgcccgttcaagcattagaggaaaggttgcccgtggtatcgctggtaaattcttcttcccactttcaaatctagaatagtaaaacagccaaaatcccaacaggcatgagagttatcgcagtagataggttaagctgcttctctgctgtggtcaacgtcagctctgttgcgaggcgggttctcccaacaatagcccacaccatttccaggcttttctgggcgaggggcagggcgcccggcccccaaagcgagaagacagacagccccggttctccgcagccccaggtttgctcctcaaggacggaggggcctctcagctccggccgcctcctttccgccccctgcaggccggccggaggaaagctcagggcccaggtcggcccagggagcacggaaccaaagagcgctagcgccggttcggccgcctttccagaaagcccgggccgaacggccccgccgcagagactcagcgcggatcgctgctccctctcgccatggcgcaggtgctgatcgtgggcgccgggatgacaggaagcttgtgcgctgcgctgctgaggaggcagacgtccggtcccttgtaccttgctgtgtgggacaaggctgaggactcagggggaagaatgactacagcctgcagtcctcataatcctcagtgcacagctgacttgggtgctcagtacatcacctgcactcctcattatgccaaaaaacaccaacgtttttatgatgaactgttagcctatggcgttttgaggcctctaagctcgcctattgaaggaatggtgatgaaagaaggagactgtaactttgtggcacctcaaggaatttcttcaattattaagcattacttgaaagaatcaggtgcagaagtctacttcagacatcgtgtgacacagatcaacctaagagatgacaaatgggaagtatccaaacaaacaggctcccctgagcagtttgatcttattgttctcacaatgccagttcctgagattctgcagcttcaaggtgacatcaccaccttaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggttacaaatgctgctgccaactgtcctggccaaatgactctgcatcacaaacctttccttgcatgtggaggggatggatttactcagtccaactttgatggctgcatcacttctgccctatgtgttctggaagctttaaagaattatatttagtgcctatatccttattctctacatgtgtattgggtttttattttcacaattttctgttattgattattttgttttctattttgctaagaaaaattactggaaaattgttcttcacttattatcatttttcatgtggagtataaaatcaattttgtaattttgatagttacaacccatgctagaatggaaattcctcacaccttgcaccttccctacttttctgaattgctatgactactccttgttggaggaaaagtggtacttaaaaaataacaaacgactctctcaaaaaaattacattaaatcacaataacagtttgtgtgccaaaaacttgattatccttatgaaaatttcaattctgaataaagaataatcacattatcaaagcccca

SEQ ID NO: 344880 - DNA, 2521 bp, Homo sapiens
atgttttttggacttacgtatttctttttattcaagaactctatccaatatatacacattttccttttggcttttgtcatttgtgtctttaagactttgaataatgtttttaaataatattaactttaatctttcatacacctttcagaaatttactatttgtattttgttttgtgtattttgtaacacacaagttgtaaatgattatgtattttctgttcaattccatctttcatttttatgcttaaaaatgtcttcttagtcatatatgcccgtctacattttcttctagttcttttattagatatatctagtattaattcgtcacccatttgatacatggtaatttttttcatgatgtggacatgaagtaaatattctgatttttaaatgtttccattataattggctaccattgtcaattttcttattggttctgatacttattcggtttcttagttttccaggtaataatttatctgcaagtcagcgtaacttaattatttgttttttaatagttcagtattaccattgcctttgttgtttcattgagaacttccagtacaatgtcaggagggggaaaaaaacaacggcaatggcaccaatccttctcttgttgttcatctttatattccttagaacatacggaatgcgttctgacatagaacttattgaagagtaatttggaattttctgatgaatcaactgtctttaatctttacaagtttgaaaggtatacgttattgtttccatttcccagatggagaaattgaggttcaggaaggttacacaaagtcccaggtctaagaaaaatgtctcccagattcccaaaagatgtttctattatgctaatagtgcccgttcaagcattagaggaaaggttgcccgtggtatcgctggtaaattcttcttcccactttcaaatctagaatagtaaaacagccaaaatcccaacaggcatgagagttatcgcagtagataggttaagctgcttctctgctgtggtcaacgtcagctctgttgcgaggcgggttctcccaacaatagcccacaccatttccaggcttttctgggcgaggggcagggcgcccggcccccaaagcgagaagacagacagccccggttctccgcagccccaggtttgctcctcaaggacggaggggcctctcagctccggccgcctcctttccgccccctgcaggccggccggaggaaagctcagggcccaggtcggcccagggagcacggaaccaaagagcgctagcgccggttcggccgcctttccagaaagcccgggccgaacggccccgccgcagagactcagcgcggatcgctgctccctctcgccatggcgcaggtgctgatcgtgggcgccgggatgacaggaagcttgtgcgctgcgctgctgaggaggcagacgtccggtcccttgtaccttgctgtgtgggacaaggctgaggactcaggtgcagaagtctacttcagacatcgtgtgacacagatcaacctaagagatgacaaatgggaagtatccaaacaaacaggctcccctgagcagtttgatcttattgttctcacaatgccagttcctgagattctgcagcttcaaggtgacatcaccaccttaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggttacaaatgctgctgccaactgtcctggccaaatgactctgcatcacaaacctttccttgcatgtggaggggatggatttactcagtccaactttgatggctgcatcacttctgccctatgtgttctggaagctttaaagaattatatttagtgcctatatccttattctctacatgtgtattgggtttttattttcacaattttctgttattgattattttgttttctattttgctaagaaaaattactggaaaattgttcttcacttattatcatttttcatgtggagtataaaatcaattttgtaattttgatagttacaacccatgctagaatggaaattcctcacaccttgcaccttccctacttttctgaattgctatgactactccttgttggaggaaaagtggtacttaaaaaataacaaacgactctctcaaaaaaattacattaaatcacaataacagtttgtgtgccaaaaacttgattatccttatgaaaatttcaattctgaataaagaataatcacattatcaaagcccca

SEQ ID NO: 344881 - DNA, 407 bp, Homo sapiens
actcacagttccacatagctggggaggcctcacattaatggcagaaggcaaggaggagcaaatcagatcttacatggatggtggcaggcaaaaagagagcttgtgcagggcaattcccatttttaaaaccatcagatctcgtgagacccattcattatcacaagaacagcacaggaaagacctgcccccatgattcaatcatctcccaccgggtccttcccacaacacgtgggaaatatgggagctgcaagatgagatttgggtggggacactgccaaaccatatcatccatagatgtacaattaggttatttcccataagtgtgtattttattcatgtatcattttgaatatcttcaagtatacctataaggtaaatttttagtattgctgagtcagagaatgtgt

SEQ ID NO: 344882 - DNA, 330 bp, Homo sapiens
tactttatgcaggatttttgcatacagcttcataagggatattggtttaaagatttccatttctgttgatgatttgtttgtatttcattttagggtaatattggcctcattaaattagttgagaagtattctattttgggaggtaagtggaagagaataatttgtaaaccattttcgtgaactatctttaaatatttggaagacttgggttagtgaaacatctaggaacggcattttccttgtggacaggtttttgaatacggattcagtctgttcacttctcataggtctattcaaattgtgtatttgttcttgggtcaaatttgacag

SEQ ID NO: 344883 - DNA, 544 bp, Homo sapiens
cagcaggtatctatctttatccaaatccctatagccagctgtattcatttgcacttgtttgtatttcttgctaagtgtcaagtccctccaaattactgattgtaagatcttttgagagcaaaaatggtattttcttactgttttcttcctttccactgatgtgtgtgcgctcttcttgtgattgacctttaaacccactaacatcagtaggtctttcttcctgaattaagtgctgctagctccagtgggaacagactaagcttacccatgtattctattctgagttggaggcctgctaggtaaacggcatgtccatattctgtagtgtattttttcccaagaaacacagtaattctcactcacctccacggaaccatactgatgcaggcagtaaggggtgagtctaacctttccaggaaacttcacaatttacttagaatcacaaaattgctgggacagagcctatcttctgaactttcaactgatgctctgcccagtagacttgtcttttttttttttttttttttttttttgagacagagtt

SEQ ID NO: 344884 - DNA, 566 bp, Homo sapiens
gtgccagagaattctaccatgagatgtgtattttgcttcagatgcctcagaagacaatataaaggaccaagaatgatggtgatactgcatcataaggaattgatttagttcaaccaccttttatatgccaagctgtgtgcagaaaggacatctggttcaaagcaggagcaatgagtgcggatacctagattaagaaggaaaaccagtatagcccttttgagctagcatgatctgaccattggcatgttccttttgcccaccgtgagtgcagatagtgacaccatgagaatcaccaaacagaagtaccagtgtctaaagaaatcaatatgtaaaatgatatcttctgagggataaaggatattgagtttagaaaacaagctgttaatgaaaggatttagatgtctttataatgtaaaatagaactgtcaaaagtaaattcaacactacttgggagggtaatatgggaggatcactcgtgccaggagacggaggttgcagtgagccgagattgtgccactgcagtccagcctaggcaacaaagtgaggctctgcctcaaaaaaaaaaa

SEQ ID NO: 344885 - DNA, 541 bp, Homo sapiens
gaataatttaccaacattaaaccgcacaattggcaaacacacacacattcgagactctatgttgaagatgcctggactaacctactgaagatacgtggttttaccaacagccagcaccaataggaagatatgaatgaagccatctgagaccagccatctggcagccaaactgccaactgactgcaaatgcatgaatgatcccactgacaccacgtagagcacaaatgagttgcctccactgagcccagcccaaattgttatcctataaaatcataaaaacataaacagttgttttaagtcactaagttttggatagtttgttatacaacaaaagctagctgaaacaaatgtattagctagagcagctgtgaatggcactatttgcttagttgattggctgaaatttggactcactggtaggttacatttaatggtgttgagttgccagaatttctctggaataatgtataggaaggattctaatggcctaagccattagaatctctaaggagatagaaataaaggagtgatttattatatg

SEQ ID NO: 344886 - DNA, 467 bp, Homo sapiens
tgcataagcctcgcccgcggccgccgggttgcgtccgcacttctgcgcgctggcccctcccttgctcctctccctagcagtctccagggttttaccgggaggacctaggcaacggcctgagactccgaggcaagtggggcgagtctagggataacgcagcagcaaggctactgggccggtggaacacgccctggcctggccaaattggacctcccttccggattggcggggtctcggtgggggcgggccggttgccggggggagctggagtcacgtgacggccggcgcggtttcccactttgggctgccggccgctgtggctgtggtgggcggtaggggcttttaccgtgtgagctcctttaatgccggggtctgcagtgagagctggtgatgaagctcctgccggtgtggagcttacatccctaagggagcgtttatttaatcagtaaataaaccactcaccatga

SEQ ID NO: 344887 - DNA, 661 bp, Homo sapiens
tgcataagcctcgcccgcggccgccgggttgcgtccgcacttctgcgcgctggcccctcccttgctcctctccctagcagtctccagggttttaccgggaggacctaggcaacggcctgagactccgaggacatttttaaagattggaatgatctcgttcttgaaacctaggtactctatgttgaagatgcctggactaacctactgaagatacgtggttttaccaacagccagcaccaataggaagatatgaatgaagccatctgagaccagccatctggcagccaaactgccaactgactgcaaatgcatgaatgatcccactgacaccacgtagagcacaaatgagttgcctccactgagcccagcccaaattgttatcctataaaatcataaaaacataaacagttgttttaagtcactaagttttggatagtttgttatacaacaaaagctagctgaaacaaatgtattagctagagcagctgtgaatggcactatttgcttagttgattggctgaaatttggactcactggtaggttacatttaatggtgttgagttgccagaatttctctggaataatgtataggaaggattctaatggcctaagccattagaatctctaaggagatagaaataaaggagtgatttattatatg

SEQ ID NO: 344888 - DNA, 821 bp, Homo sapiens
tgcataagcctcgcccgcggccgccgggttgcgtccgcacttctgcgcgctggcccctcccttgctcctctccctagcagtctccagggttttaccgggaggacctaggcaacggcctgagactccgaggacatttttaaagattggaatgatctcgttcttgaaacctaggtactctatgttgaagatgcctggactaacctactgaagatacgtggttttaccaacagccagcaccaataggaagatatgaatgaagccatctgagaccagccatctggcagccaaactgccaactgactgcaaatgcatgaatgatcccactgacaccacgtagagcacaaatgagttgcctccactgagcccagcccaaattgttatcctataaaatcataaaaacataaacagttgttttaagccaaaaaaaaaaaaaaaaaaaaaaaaaaaaattgtggggggggcctggggccctgagaaagtttttaacacaccctctgtttggggggcgggggcccctgggtaggcaccccggggccaatggcggtccccagggaaccgcggcgcaagaatacagggcggcgtctcccccataaaaaaacgcggggggacccggggtgtctcggaacaaaccccgatggtgcgcgggcccgcggttccacagcggcccgggacgaaatagccgccgcgcggaagaagacaccaagagacacagaacacacacgcagaagcacgagaaagacagaacccggagcgacgacaacgcgcggaaccagagcaaacgcagacacaacgacacacaccaccagacacgacgcgaccca

SEQ ID NO: 344889 - DNA, 596 bp, Homo sapiens
ttgtcctgtccgttgtcgcgtgtttagcagcatcgtttgtacatactagatgccagtagcaatcccctctcccaagttgtgacaaccaaaaatgtctctagacatagccaagtgtcccctggaggacaaaattgtccccagttgagatccactgatatataatgaagtaaaatttagtctgtgtagcatcttgccctgaggggaataatagtgaaaaaaatcaaagaatatcagaagcagtcttattcccatttgaaatgtatgtctaaacattgtatatatctgcttgtgagagtgaattaaattactaaaataaaaataaagtctaaaacacaccaaactattttgaaatattttgcacttttaaaatgctttactttttgtgtctttgaatacttttgtaattgttaaatgctttttcttttcttttttttaactatttctctgacagtaaataagtagtagtgtctttttcttcttacagtcaggaaaatggcgatgtcaaagacttaaaaagtcatttatcaaaccaaaactcaaactggcgatggagacacaaattgattagcaagcatcagtctaattatataggattc

SEQ ID NO: 344890 - DNA, 272 bp, Homo sapiens
tgatgctccagtggataactcagcatcccagcctaggcccaatgccactgaagatggacctgccccctggggacccaggagtcctaccactcagctgtccccaggagtgcccagaccctcattcttatccaggacctaggagccctacccctggccttccctcatcagccgtaaatgatgatttactgctgttaccatcatcactgccttcagtgaccaagggccttccaaggtgccagctctggaacgaaggatgcccttgggaggtgatg

SEQ ID NO: 344891 - DNA, 140 bp, Homo sapiens
gcggccgcctactactactactgctcgaattcaagcttctaacgatgtacggggacatgtaacaagtttctcaaaccaccaacagccaagtggatttggtacagtgcggctgtctaataaataatcaaaagcatttgata

SEQ ID NO: 344892 - DNA, 421 bp, Homo sapiens
  misc_feature (17)..(17): n is a, c, g, or t
  misc_feature (30)..(30): n is a, c, g, or t
ccacatacggctaggtncgaggctgggtgncggctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctg

SEQ ID NO: 344893 - DNA, 386 bp, Homo sapiens
atttcactttcacttcctctctctctctgtcttcactgactgcacttcttcaggagaagcttttgttatctgtatcacgcaggacatgctgctctttctgtttgtgtgcttacccatcacttggatggcagaattcttgtcacaactgagaccaccttctataaaactgaagaaaaggtgactggtctcatgagccctgaagaatgaactcagaggaggttgtttacatgaggttctcccactcaccagctgttgagagtctgcgattatgaagagcaggatcttattacttcaatgaaagcatgtaacaagtttctcaaaccaccaacagccaagtggatttggtacagtgcggctgtctaataaataatcaaaagcatttgata

SEQ ID NO: 344894 - DNA, 4564 bp, Homo sapiens
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaaca

SEQ ID NO: 344895 - DNA, 4558 bp, Homo sapiens
cgcgaacgggaagactatcttgcgagttgctggacagaacgagtcgccccgttccagaacaggacatacgacgtcaccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaaca

SEQ ID NO: 344896 - DNA, 4229 bp, Homo sapiens
gtatagagaatggaggagcagagttgctggtataagggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaaca

SEQ ID NO: 344897 - DNA, 4505 bp, Homo sapiens
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaaca

SEQ ID NO: 344898 - DNA, 4518 bp, Homo sapiens
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacattgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaaca

SEQ ID NO: 344899 - DNA, 4394 bp, Homo sapiens
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaaca

SEQ ID NO: 344900 - DNA, 4509 bp, Homo sapiens
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatgagtttgtgggagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaaca

SEQ ID NO: 344901 - DNA, 3590 bp, Homo sapiens
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctg

SEQ ID NO: 344902 - DNA, 4601 bp, Homo sapiens
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaacattgtgtttagaaattataatctatgtgtaaccatgaa

SEQ ID NO: 344903 - DNA, 2535 bp, Homo sapiens
atttcactttcacttcctctctctctctgtcttcactgactgcacttcttcaggagaagcttttgttatctgtatcacgcaggacatgctgctctttctgtttgtgtgcttacccatcacttggatggcagaattcttgtcacaactgagaccaccttctataaaagcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaaca

SEQ ID NO: 344904 - DNA, 2458 bp, Homo sapiens
gtgaccatgtgtatatttgtaacatcattcatgatctccttttaatggtaattgtctaagattatactctgtatgactttgttttctaggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaaca

SEQ ID NO: 344905 - DNA, 4510 bp, Homo sapiens
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaaca

SEQ ID NO: 344906 - DNA, 4126 bp, Homo sapiens
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaaaagaggcccaagacgatttagagtccccggggacgggcacaaatcttcgcgaacaaaaggcattgggcccctctaacgaagaacgtagaaacgcgggcaatcgaacccgggactagcggaacagggctctacaccgagtcagtggcccagagggggcaacaaaaagcaacacgtgtgtgctaaaggggagactacacattcacaagcgggtgggccctcaaaactgtggcggcccacaggggccacacgggtatgctgtggaacaacgactatgcagggcgacacaaaacacccagaagccagtgggggcacaaaatctgcggaaacagcgccgccgggaggcctcacgccagcaaaagcgccgactagaaacaacagcgcgcgagagatcccacacaaatcgtcgcgccaaagaacgcggcgaaacgtaaaaaccaacacgtgaacaaccaaagtagaagaagcgcaactcggtcagcaaccaagcacccggggaacgacacacctttgcgca

SEQ ID NO: 344907 - DNA, 4266 bp, Homo sapiens
  misc_feature (4266)..(4266): n is a, c, g, or t
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaaaacggccccaggatttttatatttcttctccccaggggagggggaagactctctttttgggacaagagaagcgcttttggtcttcctatacacaagaacttaacaccgcggagaattatgatccgcgatattatatggagaacttcgccttacctagttatgtgtccctcgtagcggctttaaaataagacgcacgccgagttggcataaagtgtcgctcccctttcccaaggggttggacccttttaaatttgggcttggccacagggtaactgggtgtttctcttcaaacagattgtgggcggtccttaaactctaaggctggcgcctaaaattgtcgctaataaggccctggtgttttcctttcaaacaagttcctcggtcacataattccgggattcttccacaacaatatttctggcccaacaaacatctcgggtttctcaaaagactcttgtgttttcccccaatttatagagtctcttgtttttagctagactttgggcaacccccctttgcgacagattagctctttcggcaagcaaatattttcctcagaaggttagaccttcacttttctttgtcttcccccacaccagtatccgtggtccccttaattcacatcggaaaggaatttaattttttttactacan

SEQ ID NO: 344908 - DNA, 3781 bp, Homo sapiens
  misc_feature (3595)..(3595): n is a, c, g, or t
  misc_feature (3621)..(3621): n is a, c, g, or t
  misc_feature (3648)..(3648): n is a, c, g, or t
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggccccccgaaagggagtcccgcaagctacttcttgttgacccctttagacacgttgtgatgattgctcgaatctacctttacttagcaaaaattagggtgggtgggcattcttatggccgcaacttttaggcctgtagctgcgtcctggcccatgccggtggatcgaaccggttaccacctccccaaaggttgggtgttcccgccaaacatcctcccctcttgcttcctcggcggggtcgccgtttntgccgtataaccctaaaacttgtacncagggctctaattatttagacgaacanttttttacaattcttttcccaagggaggcccctttcgggcaaagcgcgggaaattcccccaaagtttgcttttttcttccactcccttccccctcgtcttaacactgttcttcaataaaggccgcctatcaag

SEQ ID NO: 344909 - DNA, 897 bp, Homo sapiens
agctactccgcgctcatatacttggcacaattgccataacaaagctaaattggttctacataaggggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaaca

SEQ ID NO: 344910 - DNA, 569 bp, Homo sapiens
agctagcaattttaagaggtgtccctccaaagtgacctgatggaagtcctgaacttggaatagaagcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaaca

SEQ ID NO: 344911 - DNA, 643 bp, Homo sapiens
  misc_feature (6)..(6): n is a, c, g, or t
  misc_feature (9)..(9): n is a, c, g, or t
  misc_feature (31)..(31): n is a, c, g, or t
gatcanagnattattcttagcaaattacacnttgttttcttaaagcattcaccattacaacaagcagaacaatggagtattagccattcatatctggtaagcttcaggaataaaaaagcaaaaaaccccaaacccacccccaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaaca

SEQ ID NO: 344912 - DNA, 2442 bp, Homo sapiens
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatgctgaagaaaaggtgactggtctcatgagccctgaagaatgaactcagaggaggttgtttacatgaggttctcccactcaccagctgttgagagtctgcgattatgaagagcaggatcttattacttcaatgaaagcatgtaacaagtttctcaaaccaccaacagccaagtggatttggtacagtgcggctgtctaataaataatcaaaagcatttgataatagaaatctgtcttgcagcactgtct

SEQ ID NO: 344913 - DNA, 2322 bp, Homo sapiens
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggtgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatgctgaagaaaaggtgactggtctcatgagccctgaagaatgaactcagaggaggttgtttacatgaggttctcccactcaccagctgttgagagtctgcgattatgaagagcaggatcttattacttcaatgaaagcatgtaacaagtttctcaaaccaccaacagccaagtggatttggtacagtgcggctgtctaataaataatcaaaagcatttgataatagaaatctgtcttgcagcactgtct

SEQ ID NO: 344914 - DNA, 1736 bp, Homo sapiens
attctatcagcagcctgccaaatggattgaagttgggaaaaatctgaggccgggggatcagcaataagtggcacgtactaaaatctcaagaataaaaccctgacctgttttaagcacctggagacaagcagagcctcttgtggagacagatgtatcagatcttcacctgacttcatttgatatctgaatcatagaactatttcatacccccttcttccaagtccaagctctcctggcatcttgtggttaggactgtatctcgttacttctgcttatcctgcagtggctctgggcttgtttgataatcaaactgagccggcccttatttttaatttttaacccatcctaatggggcttttttatttggaaatgattttaaacttatagaaatgctgcaagaataagaatggtacatagaacaccatgctacatattgttacacctctgttaaacatgtattttaccccatatgctcatccattctctctctatatctatctagatctcgatatctatctatagatatatctatatctatatgtatagatagatatctagatatatctagctattgagatctagatctagatatagatgtctatagatatagatataactagctattgagatctagatagatagttgtctagataagtatctagacagattgatatagatatatacagagaatattaggtccatactctctctctctctatatatatacacacacatatctattaggtatatagtatatacctaatacttttggatcacttgagaataatgtatatacgtcattgccctttagtcctaaatacttcaatgtgtatttcctaggaataagaatatccatttaaaagaatcatgttatacttcttatcttcagttcatttacttagtcactatttcttgaattgaaccaaactattagaacacccattatcctggtctgatctgacccactgctaacggaattacaggagtgaaaaattcaaagtttcatttgcatttcaggttttggtctttgagagtaccatagaatcaagttttgcaaatcagctttgaatttgactcaccatgggtttgtttgattcagttcaactgttctaaaaacctctttgtcaaagaacaatactaatgccaacagtggcaaacactaatctagccttccttgatatgtgtcagacagtgttttaagtactttgtatttaccaatgcatttaatccttacaacaaccttaaggaaaccataattatctcaattttatacattgggaaatgtaggcacagattttaaataacttgtgcatgaatacacagttgataaggggatctcccagatatctttttaaatttgttaatctgtgtgtgtgtgtgtgtgtgtgtagccttcttacatttcataatgttttctttaaagacgatcccacactatttctagttattgattacttctcattgtgtcatgttcccctaggacagaagcattcattttcttgatgtgttttttcagctgaagaaaaggtgactggtctcatgagccctgaagaatgaactcagaggaggttgtttacatgaggttctcccactcaccagctgttgagagtctgcgattatgaagagcaggatcttattacttcaatgaaagcatgtaacaagtttctcaaaccaccaacagccaagtggatttggtacagtgcggctgtctaataaataatcaaaagcatttgata

SEQ ID NO: 344915 - DNA, 1134 bp, Homo sapiens
  misc_feature (1014)..(1014): n is a, c, g, or t
  misc_feature (1032)..(1032): n is a, c, g, or t
  misc_feature (1053)..(1053): n is a, c, g, or t
  misc_feature (1061)..(1061): n is a, c, g, or t
  misc_feature (1071)..(1071): n is a, c, g, or t
  misc_feature (1079)..(1079): n is a, c, g, or t
  misc_feature (1089)..(1089): n is a, c, g, or t
  misc_feature (1094)..(1094): n is a, c, g, or t
  misc_feature (1096)..(1096): n is a, c, g, or t
  misc_feature (1099)..(1099): n is a, c, g, or t
  misc_feature (1103)..(1103): n is a, c, g, or t
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacangtgtactatggtggctgnatgcgtcttcgggcccttctnatttatgncatttaactncagaggtnacaaggatcntattncngantggngggtatgcgcacacgtgttgttcttacctct

SEQ ID NO: 344916 - DNA, 533 bp, Homo sapiens
atttcactttcacttcctctctctctctgtcttcactgactgcacttcttcaggagaagcttttgttatctgtatcacgcaggacatgctgctctttctgtttgtgtgcttacccatcacttggatggcagaattcttgtcacaactgagaccaccttctataaaagtaagctgaaaggaacagcatcctcgtcagtgctcggcaggggcgggtaggggatgatggttttttccctaaggtaaaactgctgttgctcttgtttcctttttaactgtcagtgtttggctttcatcagactgaacattttggtgtacacttgaactgacggtttgatttttatcattttggaaggtgatcatagcaattcctttcaacttgctaaaattcatactcccccttttaaaagtatggttctgcttacattgctgtccttttcccttggctgactttttcttctgttgcctaggttgtactttctttgtttcttaagctatttttcagtagcaaacaaggctgttttcatcaataccca

SEQ ID NO: 344917 - DNA, 673 bp, Homo sapiens
cagaaacaaaaaataaagccatcataaaaccattggtgccaaaagatatttgttagttattgttatacagatattacaacaaaatatgaatgaaatctcattttaggtacaatttgctgtgccagctgctgaagatgggatgtgggggtgggaggaggcaaagggtgaatctgacacagatcccacttttaaggagctgttggtctaataaggaagatacaaataaaaacctcgtttttgtggtgtatctgtttaaataaataaagagtctcatcctgactgacagtatgttttggttcataatgagtggcaaagggaaaaggaaaaaaattctagaatgtattaataagttgagaaatccttttatgttttgctttaaaggtcacttggtaaccataatataaaattgacaataaatattgcaagagagatacttactgataaagtattattgaaattcaaagaatgctacctccaggtttggggctgaagggttatgttaaaaatttctactattttcggtttctgttttcactacttataataataactgaaaccattctctccatacaggtgatcttattcctgataatgttggttatgcgcaaacgtgttgctcttaccatcgccttgttccacgtagctggcaaggtcttcattcacttgccactgc

SEQ ID NO: 344918 - DNA, 333 bp, Homo sapiens
gatattaaatatgatctttgttctctctgcttcaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggtaagtacttcaaatgccgtttcctattttagggataaaaataccaataaaaatattttgt

SEQ ID NO: 344919 - DNA, 4486 bp, Homo sapiens
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaaca

SEQ ID NO: 344920 - DNA, 4508 bp, Homo sapiens
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaaca

SEQ ID NO: 344921 - DNA, 4400 bp, Homo sapiens
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccacaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaaca

SEQ ID NO: 344922 - DNA, 4560 bp, Homo sapiens
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttgccccccacgttcccaaacccttcttcaagagctgaagggatcccagcccctaggtgggcataggcagaccctccccagagctccttaggaataagacagactggttcattgaatgccgccttatttatttttggtgaggatgcatgcgtggggccgttggtgtttagagtgggggctacccaattaatctttgatactctc

SEQ ID NO: 344923 - DNA, 3603 bp, Homo sapiens
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgagaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagaccgcttgtaactatgcattacggcccgttgggtgggcggggggggcgggg

SEQ ID NO: 344924 - DNA, 2415 bp, Homo sapiens
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatgctgaagaaaaggtgactggtctcatgagccctgaagaatgaactcagaggaggttgtttacatgaggttctcccactcaccagctgttgagagtctgcgattatgaagagcaggatcttattacttcaatgaaagcatgtaacaagtttctcaaaccaccaacagccaagtggatttggtacagtgcggctgtctaataaataatcaaaagcatttgata

SEQ ID NO: 344925 - DNA, 2698 bp, Homo sapiens
cagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatgctgaagaaaaggtgactggtctcatgagccctgaagaatgaactcagaggaggttgtttacatgaggttctcccactcaccagctgttgagagtctgcgattatgaagagcaggatcttattacttcaatgaaagcatgtaacaagtttctcaaaccaccaacagccaagtggatttggtacagtgcggctgtctaataaataatcaaaagcatttgataacaaaaagaagaaaagaagaaaaagactagagaaacaattgttggggcgcgctgggccccggaaaaaagtcttctaaaacccctcggtggggcggggggcgccagtgggctcgggaactgggcaaaagctggcccacaggagacccgggcgcctaaacagggggctggggttcccacccataataaaacgcgcggggggaaaccgagggtgtgtgagaacaacccaaggcgagccagaaggaaaacgggggcctcaacgggggccaaggaaccagataatacg

SEQ ID NO: 344926 - DNA, 758 bp, Homo sapiens
cgcgaacgggaagactatcttgcgagttgctggacagaacgagtcgccccgttccagaacaggacatacgacgtcaccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatggtaaggaaactctcacagatggtccaaactggactcatgatccaagggaatgacgagtagttgttttaatgagggcagttgtggaatataccagtcctcatacaattcagtggtattttgtgtcactcttgatttgtttttctacatgaaaactgagctcaaattaaggagcagctgggactcatatgccattcaatagaccatttcagaaagcaaatcatttgacgtaagtctctgaatgttgatcttgatagagtggtgagcaaaacagtgaccatgagtcatgagccctgcatattcacccaacccagtcacaccaacttgttggttatctttagggcagtcatttcctctcagggacttggtgttccacagttcttcctagatgggagg

SEQ ID NO: 344927 - DNA, 454 bp, Homo sapiens
agcaagaggagcccaaagtagtgatgggcagtggtaccttccagttcagtagaaacattgttgtgtcgctgggtggatacatttcttcctttggaaccaagacctctgagccaacacagcataaggtcatgaggatgggaagcagaaatttttctagtggatcactaaagatcactcatcctgggagataccatcagccacgttatgagactactccagcagttctgtggtgaggaagcaactttccagcaacaactcattatctatgggattatgtcacctggaagtgaattttctagcctcagtcaagccttcagataattgcagcctcagctcacatctgactacaaactcatgagagatttcaatccagaaacactcaagccagaaacttccaaattcctgacccagagaaattgtaacagatagtaaattagattactattgttttaaa

SEQ ID NO: 344928 - DNA, 1105 bp, Homo sapiens
cttcaggatgtttcctgctggtattagctgtgcatcaaggctaagaggtcacagcgctgtccttgccattctcaataaatcagttttgcaaaatctccaggccttcttgcagaggattcagacatagagggtgatataggtgatatagttttgctgtgtccccacccaaatctcattttgaattgtaactcccacaatgcccacatgttacaggagagacccagtggaaggtcattgaataatgggggcgggtctttaccatgctattcttgtgatagtgaataaatctcacaagatttgatgattatataagggggagtttaccctgtacaagatctctctttttgcctgctgccatctgtgtaagacatggctttctcctccttaccttctgccatgattgtgaggcatccccaattacgtgcaactgtaagtcaataaacctttttttcctatataaattacccagtctcgagtatgtctttatcagcagcatgaaaacggactaatacatagggttgtagcggatcagctataaagatgggcctccctttaggccctgcagcagtatggcaccagtttgaaagcctccatccagtccacataatgaaaatcagaaaaagaacattcaccacttatctgtgctttctgcaaagaaacagataccggggtgaggaccaagactgccttcttcttcatgtcattttgtatgtctgtgtagacagagtcggcaagaagggagatatgaagtgcttgcaaggtacctagatctgtccttgcattcagacattcccttgctacttgtaattccttgacagaagacattgtggtagtgggtacttaggagggaaacaactagaatggggcatttttcccaaggcaaacattgaatcctctcttgctgttacagagtaaaattccctgaggcctgggcttggtttttcatgcagattgaatgatagcttttaatactgtctctaatttagtaattctctgtgagctcccttgagaagagggcccaggtactcttattttccatctctcacaaagaatcaataatgaaactaagtattgaccattatatatgtcaagcatatgatatctg

SEQ ID NO: 344929 - DNA, 218 bp, Homo sapiens
ttaaaatatatatagactgaaaatatatgacaatataaaaaaaggcaggagagacagtaaatggagataaagtatactaaggttctaacatcaggaaaggaaataaagcagtaacttatatttgaccatagtcaaggatgcatgctataatctctcgagcaactattaaaagagcagtaaatggccaggtgtggtgtcttaggcctataatcccagca

SEQ ID NO: 344930 - DNA, 212 bp, Homo sapiens
ctgccactctcccctggaggctgcagtgcattggctataaagtctggtgagggaaaggcagatttccccacgaggcctgccaggtaaagccattgtaattgcctatggtcaggcctgaaaattcacacatggattttaaccaggggctgtactcttcagggacttcttcagaggacttgagattgtagtttaatttcattcccgctgcactg

SEQ ID NO: 344931 - DNA, 122 bp, Homo sapiens
attggagccagggaggctgctaaaaatcccacaatgcacaggaaaatccccccctggcaaagaaaagcaaattacccaaaatattaatagtgctaagactgagaagccctgacttatagtaa

SEQ ID NO: 344932 - DNA, 283 bp, Homo sapiens
gagatcaaggaagaggaacacgataaaatgcttatggctccaagaagaaatagggtgagagataggaccacaaattgtttactcatttcaaccagtaaacatgtcctgcaatgtcaatctgtctttctgccacagcagttctgcgcctcctgagttgtttccatctccctccagtcattcaggaccaccaatgagatttgtgatatttggaaaactgccacccagtgcctccttttcctaatctgctgaataaagttaataagactaaactatgttgccatca

SEQ ID NO: 344933 - DNA, 254 bp, Homo sapiens
acagctctgggtttgaatccccccaccatgtgaccttggccgaatgacttagcctcttgataaggtggagataatcatcatacatatctccccaggaagttaagggactcaaataagatggtgaacatgaagccctcactgattggtgggtgttacacctggtaagtgatattttccgagtggttgtgaaggggccctaaaggaagggcatgcttctgaaccgggaggtgaagtcccttcttcgcagctctgat

SEQ ID NO: 344934 - DNA, 388 bp, Homo sapiens
tgcactccagcctgggcgacagagcgagactccgtctcaaaaataaaaaatagtggctcaccagaatactctaagagtccacatggtttgatttttttgctttggttttgtttgtttttgttgccatttggctttgttactttcatgactttagttagagtgaaagcctagacccagaaatgttttactaaatggtagacaaataaatgctgggtgttctgctgctggctggttatctcagtatgagtgccgtgagttaaaaagtgactgagaaatggattattcccaaagatgaaggagatcactcaacacccttgtgagctacctcattcacacgcctgccaagaggcacattttccggtattcttccatagtttagattgtttca

SEQ ID NO: 344935 - DNA, 273 bp, Homo sapiens
aactaaaggccaagctaatttgattatgtctataaatatccatagaattaggtagtgattcagagcctcacactgtcttaacaagaacacaaatagtctgtgttgtaatgactaattgttcttcactccatgaaaatgattgaactatgtgtactgccattttctgaatacagactcccgtgtcgcccagatactgcaaaggtggtattcatgcaaaaggaatgtagcttttcaaacagtacttcatttttctcattttcttaaaaaaaaaaa

SEQ ID NO: 344936 - DNA, 991 bp, Homo sapiens
agccagtaccaagaactatcagtggccctggattcaagctccgcaataatcagtcaactcactgaaaacatcaattcactgctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacatgaacaggaggagaggcaacgtgaacaggaggataggctacatgaacaggaggagaggctacgtgaacatgaggagaggctacgtgaacaggaggagaggctgtgtgaacaggaggagaggctacgtgaacatgaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgcatgccattcttttcgggctgccgagaacagggagctaaacatcaccatcatctaagagcgggtcaaggaattgaaaaaaaaaaacaaaacatttaaggggttaatatcctacacaattcatttacttcatttgaatgttagagccacttatgtttatttgtgtttctaatttatagtttaaatttatttgtgtttctaatttatagtttaaatttatttgtgtttctaatttatagtttaaatttatttgtgtttctaatttataatttaaatttatttgtaaaaagttaaatgagagtgggtgtttctctcatgttcactctggcatctt

SEQ ID NO: 344937 - DNA, 539 bp, Homo sapiens
gaatgacttgtgccctaaacaacctcctgcacagtctgcagcttcctgagtcctgttctgaaataaaacatgaggcttttaagaatcatgtgttcaatgtagacaatgcaaaatttgtagttaaatttgacctcagtgccctgactacaattggaaatgccaaaaactcactaataggggtgagcctttaattgtaatgactttgttttatcaacattacatatttatgtatttcactgttatgtcaacatgtctgcagaatcactgtatgtaacaaacagccatatttaagacatgcctggataaataaaattggtaggaatgttttcttgccattatatttaacttttcttctttttccttgacaaatcttgataagtttttttatattagttttattttctagaaaatgtcttatgaatttctcctatttgctctagcatgcttacagaaaatgtcagtgtttcttacagctcaaatttgtatagttgttttaaaatgcggtctctttcttcttcccctggtacttttttctttct

SEQ ID NO: 344938 - DNA, 376 bp, Homo sapiens
gaatgacttgtgccctaaacaacctcctgcacagtctgcagcttcctgagtcctgttctgaaataaaacatgaggcttttaagaatcatgtgttcaatgtagacaatgcaaaatttgtagttaaatttgacctcagtgccctgactacaattggaaatgccaaaaactcactaatagggatgtgggcgctatctccaactgtctttgcacttctgagtaagaatctgatgattgtgcacagtgacctggctgttcacttccctgccattcagtatgctgtgctctacacattgtatcctcattgtaccaggcatgatcactttatctttagtagcctcagttcttcctctccttctttgtttgatggagctgtgat

SEQ ID NO: 344939 - DNA, 416 bp, Homo sapiens
acatgcatcctggttgatgaatatatttgataaagggacattgcaaacccaaatgtcttgggctgtatggcacgggtaggaatggggcccaaggtctctggatccccaccagaggccaatggctctatactcctattaagataaaatggggccaggtgcagtggctcatacctataattccagtactttgtggggccaaggcaggaggatcccttgagcccaagacttagagaccagccaaagcaacaaagtgagacctcgtctctacagaaaatttaaaaataattaggtgtggtggtgtgcttctgtaatcccagctatgtgggaggctgaggctggaggattgtctgaacctgggaggttgaggctgcactccaacatggacaatggagagagatcctgtctcaaaaaaaaaa

SEQ ID NO: 344940 - DNA, 390 bp, Homo sapiens
ggaaaatggaagtaaattctttataatatgctaattgatgtatttgggaatttttagatgtagacaacatctgtgcatgccgttaacacagttaatagctcccgttcttcaatatgagaaggttttcagagtctatgtgtgatctagatgagaccttctgtgtccgcccccccaggacttggcagtgtcaaatttaaggctgttttttctggtgccttaggactgaatctgagcctgcgcaaagtcctgttttgaggatgcttctggccacagtgtgctgggattgtgttggttctgggaagagcctggctggccagacctggtcttatctatcacccccatccctactccgtcctagcctggaccagactggctggagtgatgggtcca

SEQ ID NO: 344941 - DNA, 153 bp, Homo sapiens
tccatcctggccacaaccagagaggatgctgggaatgctcttcctggctccagtctcatggaaggattctgattggtccagctcaggtcacgtgcctctcctccatggtctggggcaagatgtgctaggcagacagatacagagacagcagcc

SEQ ID NO: 344942 - DNA, 413 bp, Homo sapiens
attttttgtttgcaccagtggaacagagctcacccgaaaaatccacaactccaaagttcaagtcagagtcttcagtgtgactctggatgttccttgatatgcctgattcctcaaattttactttatttactcctgtacacatatgttccattcttcagaaaagattctcttggggatactatttaatatacctagaaaattgcatatgcagccatttttgaaatgaaaagtgcctgatatggtttggctgtgtccccacccaaatctcaccttgaattgtaataatccccacatgtcaagggtggggccaggtggagataattgaaccatgggggcagtttcctgcatactgttcttgtggtagtgaataagtctcataagatctgatggttttataaatgggagttccccta

SEQ ID NO: 344943 - DNA, 866 bp, Homo sapiens
agcagtaaggtgaactcctggaagaaaatgaaactcttggaaactttcaagtaccatactctgcatcttgcaattgaaagaccctagaggaaggtggtaggcaaggagccaggggatgcagtgtactgtgcaaagaagcagtagttggaaacagtgttcatgaggggtccttagctttttcaatttcaggtgttcttggggaatgagaacagaaatttcctttgaagaagcctatctggtaattgtggccacatccgttatgtatcatgcaggttgaaaacttagacaggctctgatgatttctctgctatgaggtgtccagagatggacctggctgcagtatgtaggcgccctcactattaaaatcagcaggtacccagaccctgactcccattattcactccagataaactgggctacccagtggcacctgtagagttgtccttccagaagtgagaatgcttcatgggaattgtgcttaccttatacccttgacctctgacagctacattaggaaaatatgtcatattgcagggaaaaagcagttgatatgtagatttctggtagtaataaaattagcagttttaacctggtgtcagctccagaattgactttttggggaatctgggaaagttgccttggaagttgttaggtttaaacataagtaataacagcacttaaaagcattttaaaaaattacaaaattaacacccttactgattttacaataatgtgtaggaactctcatatctcccttactctctgtaattgtggtagaatacacaggaggttgaccatcttaaccattctagagtacagttcagtagcattaagtacattcacattgttgtgcagccatcactacc

SEQ ID NO: 344944 - DNA, 609 bp, Homo sapiens
taaaattagcagttttaacctggtgtcagctccagaattgactttttggggaatctgggaaagttgccttggaagttgttaggtttaaacataagtaataacagcacttaaaagcattttaaaaaattacaaaattaacacccttactgattttacaataatgtgtaggaactctcatatctcccttactctctgtaattgtggtagaatacacaggaggttgaccatcttaaccattctagagtacagttcagtagcattaagtacattcacattgttgtgcagccatcactaccatccatctaaatgactcttttcatcttgcaaaactgaaactttatacccattaaacaacagctccctattccctcctgcccctgtctctggcaagcaccattgtactttgtctctatttgataactccagatactgcaggtaagtggaatcatattgtatatattttttgttactggcttatttcacttcctataatgtcctcaaagttcatccatgttgtagcatatgtccaaatttctttcttttttaaggttgaataatatttaattgtatgtatataccccattttgtttacccattcgttcattgatg

SEQ ID NO: 344945 - DNA, 520 bp, Homo sapiens
gactatttacaaagttgagggcagcattaagggaaatcctggaagcccataacagtggggctccattgccaccccatccctgagagtggaaatggaggaagtagttactggagcccagtgagacctttggtataaaacagagttaggctggaagcagtggctcatgtctgtaatcccagcattttgggaggccgaggccggcatatcagttgaggtcaggagttcaagactagcctggccaatatagtaaaaccccgtgtctactgaatatacaggtatatgtgtatatatatatatatacacacacatatacatacaaaattagccaggcatggtggcatgtgcctgtaatcccagctactcaggaggctgagacaggggcctaggattaaataaggagttttggcaaaactaggctggaactccaaaacctgctacataagtactcacgagggttgctagttattagtattattactttgttgttatttggctctggtcagatttcaattaacgtcac

SEQ ID NO: 344946 - DNA, 446 bp, Homo sapiens
tgctgggattacaggcgtgagccaccgcgcccagcctcagtttttaagagttttaacggtaaacactcaatatatcttaactataatgaataaactgaagatacgtaatacagaaatgacatgaactgtatgtagcataagatgatccccaacattgtcttaatttcttcttgactccttccctttaaaacaaaaatttgaaagatatttaaagggcatgttttaagtgaaaaccagacatccaaaaaataaaaaagaaatgactgcttcttacttaaccatgttagatgttcagctggagaaggagagtaaatttctggatctgatgtaaattgttttcctagtgctgtaacctccataaattgatattattgtgcaccctgatcaattttgaggatatgtattgacatcgtccccatttcaccaataaaggattcatttgagag

SEQ ID NO: 344947 - DNA, 419 bp, Homo sapiens
tacgagagttctcattaacactccattcagcttcttctcatgtcaacatggtacatttgtcaaaactaagaaattaactttggtaaaatactattaactaaattgcagcatttattcagatttcactagtgttctctctctgttccaggacacaatggtgcatgccctgcccttcccttttttatctaattagtgctgaaatgtgagagtatatcagcccctcgatcttttgctgcctgtgtgctttaaagcccagagatctaatgcaaatctcatgagtgctgggcctagtgggaaccctgcttgtgctgctaggccagggacctttggacgagtgttagtgccttaggctcatttccaacttttctgaggtacctcactgagctactacaaaaagataccttttcatcccttctgtt

SEQ ID NO: 344948 - DNA, 724 bp, Homo sapiens
acctcatctgtaaaacaaaccaaaaaaccttttggtatatttactgtatttactcctagccttcttttccatgacgtttttaggtgagatcacatagtatatgtaatttattgtgctgctttttcattttaaatttatattacatgccatcattacttctgcaagttattcgctagttgtctgtctgcctgcctccttccctctcttcttctcttctttcccacctccctgccatctttcttccctccctccctccctcttttcctcctctgcctgcctgccttccttccttcttctattcttttgtcagcaaacattcattatgttccttctgtttgccagacactttactcaaacacagctttactgaaacacagctccaccctccagtgggggagatggatacctagcaaaaaataaggggtgctaaatacttaattttatgtgtataaacacacacacgtctgtttttgaggcatggtctcatgccatgctggagtgcagtggcacgatcatagcaccttgtaactttgaactcctgggctcaagcagtcctcctgcctcagcctccctggaggctgagagtacaagtgcatgtcaggatgcctggctgctttttctattttttgtagagaaagggccttgctgtgttccccaagctgttcttgaactcccggcctcaatcagtcctcatgttgggatcacaagcatgagccaccacacc

SEQ ID NO: 344949 - DNA, 271 bp, Homo sapiens
acctcatctgtaaaacaaaccaaaaaaccttttggtatatttactgtatttactcctagccttcttttccatgacgtttttaggtgagatcacatagtatatgtaatttattgtgctgctttttcattttaaatttatattacatgccatcattacttctgcaagttattcgctagttgtctgtctgcctgcctccttccctctcttcttctcttctttcccacctccctgccatctttcgtcgacgcggccgcgaatttagtagtagtaa

SEQ ID NO: 344950 - DNA, 239 bp, Homo sapiens
acatgtgacaaatgccatagaattagacccaaagaatgcctgcgaaagctgctgaaatccagtggggtctgcagcctggttcactctgtagtgaaatccagtggggtctgcagcctggttctatctgtattgaaatccagtggggtctgcagcctggtccactctgtagtgaaatccagtgtggtctgcagcctggttctatctgtattgaaatccagtggggtctgcagcctggtcca

SEQ ID NO: 344951 - DNA, 687 bp, Homo sapiens
aggtggagtccgaacccctgatgggaaactgcgggctgcccgcagtgccaccatgctgggtacatgggggacagggctgttccatcttgcgggtacctgccccttcaccaggggccttgggaggggccatcagaaatggcgtgacctgtgcagcctgtcctgggttctgtaagccagtgtaggtgctgtccctgtgaggcccgtgtgcctcccctcactgctccgagctctctggctgaggagctggggcaggagccccgggagggtctgagaagactcagagagaggtggactctttgtagctggtactaggtttgctttacagatggggaaactgaggcacagagaggttgaggcattagtagtactacatggctggctggagagccggacagtcagtgtcccagcccgggcttggctctcatggcatgcagagccccgggcacctcctctcctctgtgccccgcgtgggactctccagcccgacgggaggtgtgtccaggaggcgacaggctaagggcagagtcctccacagagcccaggctgacaccagtcccccccacagagagaggaggtcccgggctctgcatgccatgagaccaacccgggctggacactgactgtccggctctccagccagcaatgtagtacatactaatgcctcaacggatcctctaagtcggcgca

SEQ ID NO: 344952 - DNA, 515 bp, Homo sapiens
tgggaggggccatcagaaatggcgtgacctgtgcagcctgtcctgggttctgtaagccagtgtaggtgctgtccctgtgaggcccgtgtgcctcccctcactgctccgagctctctggctgaggagctggggcaggagccccgggagggtctgagaagactcagagagaggtggactctttgtagctggtactaggtttgctttacagatggggaaactgaggcacagagaggttgaggcattagtagtactacatggctggctggagagccggacagtcagtgtcccagcccgggcttggctctcatggcatgcagagccccgggcacctcctctcctctgtgccccgcgtgggactctccagcccgacgggaggtgtgtccaggaggcgacaggctaagggcagagtcctccacagagcccaggctgacaccagtccccccgcagaggtacagccccgtggtggaggccggctcggacatggtcttccggtggaccatcaacgacaagcagtc

SEQ ID NO: 344953 - DNA, 176 bp, Homo sapiens
cgcagactcgtttttggtccttgagtgtttgggaggaaaattaagaaagatgtgtgggacgttatttctttagtttggcacactcctcctgttttcttacttaagaagtgtttccttatctaagttacctagcggctttgggaagtgttccagtttgtaatttgtgtgtgaaaggg

SEQ ID NO: 344954 - DNA, 505 bp, Homo sapiens
ggtccttttgcagaccactcactaagcaacagggctgagaatgatttcacaatcacatagcaaatgggttaaggaacaggcttggagaaatttaagccaggagacaggaagaagagaaggtataggttcctagtgaccccaaggaaggctgagcagagaccagggtgttctgctaaacatgccaagggtggggtatcacaggacataggccacacaaactgttactcttacttttcataggatgagcataagagtagccttgatagtgggggattaaacaagaatcttgacatgaggcagtgtagagtgtagatactagctctttactgaggtgctctacaaaggccagctgcctcacacctggaaatctttgggacggtggaaatttactatgcctgctgctggtgccagggagccactggtcccttgaagctgagttcaagtgcggcttcttctacttagggtgaagggtgagggctctggtcctagctcgtccaactttttc

SEQ ID NO: 344955 - DNA, 556 bp, Homo sapiens
tggagtgcaatggcacaatctcggctcactactacctccgcctctcaggttcaagcaattctcctgcctcagcctcccgattagctgggactacaggcatgcaccaccacgccagactaattttctatttttagtagagtcggggtttctccatgttggtcaggctggtctcgaaggttttttttttttttaaatcatcctttttcaaatgctccaatacagttaattactactgcaaattttatctacttttgatctatttttctactgccacaaccctggatccaggcaacaggatttctggcttgactactacagcaggagtatattgtctccctgtatcttccctgatcttccctaatctattctacatgaaacatgcataacaatcttttaagaacacatatgtgatcacacatcactccctttgttaaatctgtcatgggtttcttactgttcttagaactaaacatatgtacaaggcaggcatgagctggtcttcatccagctccagcctcatctcctgacctgaactcacaaaactgttatcatcctg

SEQ ID NO: 344956 - DNA, 354 bp, Homo sapiens
  misc_feature (333)..(336): n is a, c, g, or t
  misc_feature (343)..(343): n is a, c, g, or t
aatctttatggagaaaggagcacacacgggacactggcttaatccagctactggaaggtttcagcaaaggagagacataacagacttgcatgaagacagagttctgggcactaagaaactgagggttggctggaaagaaatgggatatttcttgattatccctgcaaccctggaaaaaggaaaagtaatccttcatcttatgggacaactgatagtcctagaagcagttcacgcactggctgtgtttattcctctgcccaggtgtctctgtttgctgccaaggcagcagttcatgtctcgtccatgtccatgttgagtgtaagatcttcgttnnnnacaaaanccaatttgtct

SEQ ID NO: 344957 - DNA, 1883 bp, Homo sapiens
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcagtgactttttgaatgagtatgaaaaaggaaggactcccaatcctgacatagtttgcaacaagcacatcaaatttagttgcttttttcattatgctgtggataatcttggggcagatgccattgccacaggtcactatgcaagaacttccctggaagatgaagaagtctttgagcagaagcacgttaagaagcccgaagggcttttcagaaatcggtttgaagttagaaatgccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaagga

SEQ ID NO: 344958 - DNA, 1860 bp, Homo sapiens
cagtttgctgtgagaagaccagaagggttaaccaacggcctcctgtccctggacgggtcttggtgcctgcttagaacccaaagcccttaacttcatgctcctcgtcctgcttcaggggcggggcttggcacaatcccaggaggtgccaggtctcaatggcccgaggccatgggtgggtgacagggagcaggggcctcagaaccaacctagggtatctggggccccccagaccagggccagtcctggggcacctgtgggaagccagcagctaccagtccctcctttctcctcagccatttggtgtgtggaggaattcctggggtggccttgagagaagagcccgtggtgtggctggcccctgtccctgcgaatagaaaaaccagtcctcgaggggggccgtgctgctgccccacaggtggttgcaggtagagggcctgagtcagacttgaacctgcagcattcactgtcatgggctcggatctcacccctgcctcttgcccactctgacatggtacttccttcctgggccttagtctcctcatctgtaaaatggggattcaaaggcccggcgggtgatgagatgaatttctgtgggtagaacacttcgagcggtgccagcaccgttacctgtgtgtgtgtgtgctggtaggacagttgttcccagggaccacactgaggccggccttggggccaggtgcccctcggcgtccccaccttcacattccattctgcaggccccccggacagaccacccagccctgtacagggacctgctgaggaccagccgcgtgcactggattgcggaggagcctcccgcagcactggtccgggacaagatgatggagtgccacttccgattccgccaccagatggcactaggtgactgacgggagggctcctgaggacgggccccttgaagctgagcttcctgaggccagatttgggccagggatgggagaccctggggtaggaaagtcccgttgtggagatcatttggagattacctaaagtatttagaactcccgtgtcctgtgcctgccctgagcgaggcctgggggtgctgggagcagatgcaggcaggccccggcgtgttgggctgaagcaagtgtgtacactgccccgcagtgtcctgctgcgtccagggcccaggctggtgccctgcccttcccctctaagcaggggtttttgaccccgtgggctggtgctcctttctccctgggggcctgaggtcgaccaggaaaggcctgtgccccctccaagggcccctctcttctacccagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaagga

SEQ ID NO: 344959 - DNA, 1089 bp, Homo sapiens
gtcttctcatttcagagcatgggcatgtgtttcatcgggaagaggaattttgaacattcccttctctggtccctgtctctcccccactcctcgcaggacagtggcctgaaggacctgaccgggttctgctttcttccccggggcagctggtgtgagggtctcccgcgcagggtcagaccccgcgggccgagacaatgaggcgttctctaaggacttccagatgtggcctcagctgagatgctggagttcatgaaaagcgcgcctctgacttggaaggactatactctgtgagttacgtatcaagtccctgtaaaaagaatgatttccttcctgtgtaaggaaaatgttaaactacacaaaactccactctgattcagggagtaaggtggacgtcccggcatggtgtgaatgattaaggaccacatgcagcgatgggatcaggcgtccgcgctggccagagtgctgctcgctcatgtgcagacccttactgcggtgaggcctgcgtgagcctgtgctgtgcctggtgtcaggggacaggctccgagtcagtcacagtgtgcagtcctgctgtggggacagagtgcagccattgttgggttagtacagtggcggggatgtgcctgccggcgtgatgatcaggcaggtcttgacacagcacagacctgagctgtgggactggccaggagagccaggctgcagctcaggtgtagggcgtcttgcagtgaattgcacttggagatcttccacctcttgtggaggggagacggcaggcggagccggggctaggcattcctgagacaggtggaggtgacagctttgcttgggacagaactgccagacaggattgcccatgtatctgccagccctggccccagcaggagccagttggatgactcatggcttccacctgcagttcacttcactgaagaaggctgccggcccaggccacgtggtaaatccatgaggttctctctgcctgtgtgccccactgcaggggagggaggcagtgagtttgccatctgctgtgtgacattgtgagggtgcgcagagcagctgggggtagccctgatgcagttactgcattagatg

SEQ ID NO: 344960 - DNA, 425 bp, Homo sapiens
ttttttttttgaggaatgtttcacacttggaactgaagtcattttcttttattctagtgactttttgaatgagtatgaaaaaggaaggactcccaatcctgacatagtttgcaacaagcacatcaaatttagttgcttttttcattatgctgtggataatcttggtaagtaatttgggtttaaaacatttttttttttaaagacagggtctcgctctgtcacccaggctggattgcagtggtgcgatcatgactcactgcagcctcgacctcctgggctcaagagattctcccaccccaggctcctgagtagcttggaccacaggcatgccaccatggtggctaattttttgtggagatggtgtcacaactgtattgtccaggctggtctcagatttctggccttaagcagtcctcctgcctcgg

SEQ ID NO: 344961 - DNA, 1938 bp, Homo sapiens
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcagtgactttttgaatgagtatgaaaaaggaaggactcccaatcctgacatagtttgcaacaagcacatcaaatttagttgcttttttcattatgctgtggataatcttggggcagatgccattgccacaggtcactatgcaagaacttccctggaagatgaagaagtctttgagcagaagcacgttaagaagcccgaagggcttttcagaaatcggtttgaagttagaaatgcggtaaaactcctccaggcagctgacagctttaaagaccagaccttctttctcagccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaagga

SEQ ID NO: 344962 - DNA, 1558 bp, Homo sapiens
cgcgggtcggcaggaggataccccgtcctctgactttggttcggaggctcctcgccctccacctgtgtagtcggaggtgtgcgcgactgcagctccgactacctgggagcagttccgcgcccctctccacccacgcgcgcccacccacagttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcaggggcagatgccattgccacaggtcactatgcaagaacttccctggaagatgaagaagtctttgagcagaagcacgttaagaagcccgaagggcttttcagaaatcggtttgaagttagaaatgcggtaaaactcctccaggcagctgacagctttaaagaccagaccttctttctcagccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaagga

SEQ ID NO: 344963 - DNA, 1776 bp, Homo sapiens
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcaggggcagatgccattgccacaggtcactatgcaagaacttccctggaagatgaagaagtctttgagcagaagcacgttaagaagcccgaagggcttttcagaaatcggtttgaagttagaaatgccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaagga

SEQ ID NO: 344964 - DNA, 2057 bp, Homo sapiens
  misc_feature (1951)..(1953): n is a, c, g, or t
  misc_feature (1976)..(1976): n is a, c, g, or t
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcagtgactttttgaatgagtatgaaaaaggaaggactcccaatcctgacatagtttgcaacaagcacatcaaatttagttgcttttttcattatgctgtggataatcttggggcagatgccattgccacaggtcactatgcaagaacttccctggaagatgaagaagtctttgagcagaagcacgttaagaagcccgaagggcttttcagaaatcggtttgaagttagaaatgcggtaaaactcctccaggcagctgacagctttaaagaccagaccttctttctcagccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaaggaaaaaaaaaaaaannnaaagggcccttttcccaaattcnccctattgaccgggcttaaaattacaattgccgaccttttaaaacctctggttttgcgaaaattattgggtatcccactgt

SEQ ID NO: 344965 - DNA, 2068 bp, Homo sapiens
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcaggggcagatgccattgccacaggtcactatgcaagaacttccctggaagatgaagaagtctttgagcagaagcacgttaagaagcccgaagggcttttcagaaatcggtttgaagttagaaatgcggtaaaactcctccaggcagctgacagctttaaagaccagaccttctttctcagccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggtgaggtgcagactctgccacttgtcatctgaaatgcctagagctgtggcgtttcagctctgggagactagaccagagttcctgtcgtcccttccacttggctggagaattgtagaaggctctgtggggcggccgggggcgggcacggcctagggtggaacagttgccttgatggtggctgggtgcacttccagatgtggcctcagctgagatgctggagttcatgaaaagcgcgcctctgacttggaaggactatactctgtgagttacgtatcaagtccctgtaaaaagaatgatttccttcctgtgtaaggaaaatgttaaactacacaaaactccactctgattcagggagtaaggtggacgtcccggcatggtgtgaatgattaaggaccacatgcagcgatgggatcaggcgtccgcgctggccagagtgctgctcgctcatgtgcagacccttactgcggtgaggcctgcgtgagcctgtgctgtgcctggtgtcaggggacaggctccgagtcagtcacagtgtgcagtcctgctgtggggacagagtgcagccattgttgggttagtacagtggcggggatgtgcctgccggcgtgatgatcaggcaggtcttgacacagcacagacctgagctgtgggactggccaggagagccaggctgcagctcaggtgtagggcgtcttgcagtgaattgcacttggagatcttccacctcttgtggaggggagacggcaggcggagccggggctaggcattcctgagacaggtggaggtgacagctttgcttgggacagaactgccagacaggattgcccatgtatctgccagccctggccccagcaggagccagttggatgactcatggcttccacctgcagttcacttcactgaagaaggctgccggcccaggccacgtggtaaatccatgaggttctctctgcctgtgtgccccactgcaggggagggaggcagtgagtttgccatctgctgtgtgacattgtgagggtgcgcagagcagctgggggtagccctgatgcagttactgcattagatg

SEQ ID NO: 344966 - DNA, 1317 bp, Homo sapiens
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcaggggcagatgccattgccacaggtcactatgcaagaacttccctggaagatgaagaagtctttgagcagaagcacgttaagaagcccgaagggcttttcagaaatcggtttgaagttagaaatgcggtaaaactcctccaggcagctgacagctttaaagaccagaccttctttctcagccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggtgaggtgcagactctgccacttgtcatctgaaatgcctagagctgtggcgtttcagctctgggagactagaccagagttcctgtcgtcccttccacttggctggagaattgtagaaggctctgtggggcggccgggggcgggcacggcctagggtggaacagttgccttgatggtggctgggtgcacttccagatgtggcctcactgagaaggcccactctcagcaccctggctgccggctcatgttctggcacgaatgctggggcgccttctcttagacggaggcgggggccagcaggccccacccaccg

SEQ ID NO: 344967 - DNA, 801 bp, Homo sapiens
ccggcatctaaacggagccccacgggtgcttagcattcctcgggcccggcgctgaaatgagcacttgtttaacttcacctgtgtggctccccgcgggaggcctcattcacagagtcacgtttgtggagctctgctttgcgccatctttggctcctgaccttgggcaagtgaattaagccgtcccctgtaaaattcggctaacacctgcctcacggggtgactggagggattagatgacatagtacatactgatgagtacgtgctcagcacatacgaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcaggtgagtgcgggtcacagcacaaaggaagcttcctcacactgtggatccttgcagtggaaggatccggtaaccagccagaccgacgcctgtgctgcagcccagcgctctccctccacggtggtgctgaagactgcaagaggcctcagccaccctcggggctctgtgttagaggcgaggcctggaccccacagcacacccagctctctcactcctgtcattttgccacttgcctgaagtctctttaatgctttcttggaccttgagctgtttctgttgcccagttaggataggggagctaaggctgagggctcccctggaaggtgagcaccaatgcctgtgtgctatgtgggtcagcgat

SEQ ID NO: 344968 - DNA, 653 bp, Homo sapiens
gatgcagttactgcattagatggacactgtgaagacgtgcagctatgtcatgggctcagcaagaagggcccctggcgtcacacagggcacccagccgcatcctgggcctagggtcaggggctcctacagctggaacctgcaccttctggggcacaaggtgccttctttgtggccaccacaccccatgtccagcccaggcctggacaatgatgagatgtgctcaggtgcttggtcagggctggctttggtggttggagaatcgtatcttcctagtgagttacaccattgctgggcctgctctgggctgccctcccagcatctgccttcatgatgaggcgtgacatgtgggctgtaacttgttgcccagcctcatggagaaactgtctttctgtaggttggttcctgtataccttgggccagagagcaaacataggtggcctgagagagccctggtacgtggtggagaaggacagcgtcaagggtgacgtgtttgtggtgagtgggccggcctctgagacagcactggggctggttctggcagggccagcagtgcttccagaccagggcttgagaaggcctccagcagccgtggcttcctggaggctgtgactaactctgttcctgtccttggtcccctgcctttcctgggactg

SEQ ID NO: 344969 - DNA, 737 bp, Homo sapiens
ccctgagcgaggcctgggggtgctgggagcagatgcaggcaggccccggcgtgttgggctgaagcaagtgtgtacactgccccgcagtgtcctgctgcgtccagggcccaggctggtgccctgcccttcccctctaagcaggggtttttgaccccgtgggctggtgctcctttctccctgggggcctgaggtcgaccaggaaaggcctgtgccccctccaagggcccctctcttctacccagtgccctgtgtgctgaccctcaatcaagatggcaccgtgtgggtgacagctgtgcaggctgtgcgtgcccttgccacaggacaggtgcgtggggtgtgggggtgagcccggggaggactgtactgctctgcaccctgccagggcacccgggttacagaggaaggggctgaggcccaggagtagggtgtgctcgggtcacacagctggtgagggcagagtgccaccagccctgccctgggggctcctcccacagtgacaactgtgagaggatttccactctggtgtcaccaaccagccagttcctgctcgggccctgagaggctcagctgctgcccgggccccagaagcgaggacagaaaatggaaggggcatgaggacagtgctcaaagaggcagagggtcggggcccctgtgggccgagtgtgcaggagctcccagggtgggcgcctggtgggtgtaggcctgaggaatctccaggggcaggtggtgggagggaa

SEQ ID NO: 344970 - DNA, 1831 bp, Homo sapiens
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcaggggcagatgccattgccacaggtcactatgcaagaacttccctggaagatgaagaagtctttgagcagaagcacgttaagaagcccgaagggcttttcagaaatcggtttgaagttagaaatgcggtaaaactcctccaggcagctgacagctttaaagaccagaccttctttctcagccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaagga

SEQ ID NO: 344971 - DNA, 1793 bp, Homo sapiens
ccggcatctaaacggagccccacgggtgcttagcattcctcgggcccggcgctgaaatgagcacttgtttaacttcacctgtgtggctccccgcgggaggcctcattcacagagtcacgtttgtggagctctgctttgcgccatctttggctcctgaccttgggcaagtgaattaagccgtcccctgtaaaattcggctaacacctgcctcacggggtgactggagggattagatgacatagtacatactgatgagtacgtgctcagcacatacgaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcagtgactttttgaatgagtatgaaaaaggaaggactcccaatcctgacatagtttgcaacaagcacatcaaatttagttgcttttttcattatgctgtggataatcttggggcagatgccattgccacaggtcactatgcaagaacttccctggaagatgaagaagtctttgagcagaagcacgttaagaagcccgaagggcttttcagaaatcggtttgaagttagaaatgcggtaaaactcctccaggcagctgacagctttaaagaccagaccttctttctcagccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaagga

SEQ ID NO: 344972 - DNA, 1431 bp, Homo sapiens
cagtttgctgtgagaagaccagaagggttaaccaacggcctcctgtccctggacgggtcttggtgcctgcttagaacccaaagcccttaacttcatgctcctcgtcctgcttcaggggcggggcttggcacaatcccaggaggtgccaggtctcaatggcccgaggccatgggtgggtgacagggagcaggggccccccagaccagggccagtcctggggcacctgtgggaagccagcagctaccagtccctcctttctcctcagccatttggtgtgtggaggaattcctggggtggccttgagagaagagcccgtggtgtggctggcccctgtccctgcgaatagaaaaaccagtcctcgaggggggccgtgctgctgccccacaggtggttgcaggtagagggcctgagtcagacttgaacctgcagcattcactgtcatgggctcggatctcacccctgcctcttgcccactctgacatggtacttccttcctgggccttagtctcctcatctgtaaaatggggattcaaaggcccggcgggtgatgagatgaatttctgtgggtagaacacttcgagcggtgccagcaccgttacctgtgtgtgtgtgtgctggtaggacagttgttcccagggaccacactgaggccggccttggggccaggtgcccctcggcgtccccaccttcacattccattctgcaggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaagga

SEQ ID NO: 344973 - DNA, 2140 bp, Homo sapiens
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcagtgactttttgaatgagtatgaaaaaggaaggactcccaatcctgacatagtttgcaacaagcacatcaaatttagttgcttttttcattatgctgtggataatcttggggcagatgccattgccacaggtcactatgcaagaacttccctggaagatgaagaagtctttgagcagaagcacgttaagaagcccgaagggcttttcagaaatcggtttgaagttagaaatgccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactaggtgactgacgggagggctcctgaggacgggccccttgaagctgagcttcctgaggccagatttgggccagggatgggagaccctggggtaggaaagtcccgttgtggagatcatttggagattacctaaagtatttagaactcccgtgtcctgtgcctgccctgagcgaggcctgggggtgctgggagcagatgcaggcaggccccggcgtgttgggctgaagcaagtgtgtacactgccccgcagtgtcctgctgcgtccagggcccaggctggtgccctgcccttcccctctaagcaggggtttttgaccccgtgggctggtgctcctttctccctgggggcctgaggtcgaccaggaaaggcctgtgccccctccaagggcccctctcttctacccagtgccctgtgtgctgaccctcaatcaagatggcaccgtgtgggtgacagctgtgcaggctgtgcgtgcccttgccacaggacaggtgcgtggggtgtgggggtgagcccggggagctcagtgcctggtgctccgagcacaggccaggccccataggggagcactctgcccctgcctgccctcggctggctcccttgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaagga

SEQ ID NO: 344974 - DNA, 1044 bp, Homo sapiens
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcaggggcagatgccattgccacaggtcactatgcaagaacttccctggaagatgaagaagtctttgagcagaagcacgttaagaagcccgaagggcttttcagaaatcggtttgaagttagaaatgcggtaaaactcctccaggcagctgacagctttaaagaccagaccttctttctcagccaggtttcccaggatgccctgaggagaaccatcttccctctggggggattaacgaaagagtttgtaaagaaaatcgctgctgagaatagacttcatcatgtgcttcagaagaaagaggtacgagtgagcagttgcctttgattagtgcctgtttccctttcccgactgcatggcacggagcagctggacctgtgggtcccgcaccacttccccttctccaggacctaacatcaaaggcgggccttggagcaatagatggaggagtttgctgaggcgc

SEQ ID NO: 344975 - DNA, 368 bp, Homo sapiens
atatctcttccaaatgcttgatgaaaaaggtggaagggtcacttgacccagggagttgaaggctgcagtgagccctgtttttgccaccacactccagcctgggattgatttctaaagactcatgttacgtgaggaagcagctcagaagaggaaaggaaaggagtcaggcatggctcttcctcagatatctcttccaaacacatgatgaaggaggtcttgtcaacagggcaaggcaatagagaagtgatccacacagggacattgcaaagacatcaaagttatcacattggagacttttgcttccaggaaattgagaaagaaattcataacattgagtttcagtgtcaagaagatgaaagaaatggcca

SEQ ID NO: 344976 - DNA, 1256 bp, Homo sapiens
actatcacacaactatttccttggatgtaattctttgttaccctttacaagtataagtgtttacaagtataagtgttaccttacatggaaacgaagaaacaaaattcataaatttaaattcataaatttagctgaaagatactgattcaatttgtatacagtgaatataaatgagacgacagcaaaattttcatgaaatgtaaaatatttttatagtttgttcatactatatgaggttctattttaaatgactttctggattttaaaaaatttctttaaatacaatcatttttgtaatatttattttatgcttatgatctagataattgcagaatatcattttatctgactctgtcttcataagagagctgtggccgaattttgaacatctgttatagggagtgatcaaattagaaggcaatgtggaaaaacaattctgggaaagatttctttatatgaagtccctgccactagccagccatcctaattgatgaaagttatctgttcacaggcctgcagtgatggtgaggaatgttctgagatttgcgaaggcatttgagtagtgaaatgtaagcacaaaacctcctgaacccagagtgtgtatacacaggaataaactttatgacatttatgtatttttaaaaaactttgtatcgttataaaaaggctagtcattctttcaggagaacatctaggatcatagatgaaaaatcaagccccgatttagaactgtcttctccaggatggtctctaaggaaatttacatttggttctttcctactcagaactactcagaaacaactatatatttcaggttatttgagcacagtgaaagcagagtactatggttgtccaacacaggcctctcagatacaaggggaacacaattacatattgggctagattttgcccagttcaaaatagtatttgttatcaacttactttgttacttgtatcatgaattttaaaaccctaccactttaagaagacagggatgggttattcttttttggcaggtaggctatataactatgtgattttgaaatttaactgctctggattagggagcagtgaatcaaggcagacttatgaaatctgtattatatttgtaacagaatataggaaatttaacataattgatgagctcaaatcctgaaaaatgaaagaatccaaattatttcagaattatctaggttaaatattgatgtattatgatggttgcaaagtttttttgtgtgtccaataaacacattgta

SEQ ID NO: 344977 - DNA, 2790 bp, Homo sapiens
actatcacacaactatttccttggatgtaattctttgttaccctttacaagtataagtgtttacaagtataagtgttaccttacatggaaacgaagaaacaaaattcataaatttaaattcataaatttagctgaaagatactgattcaatttgtatacagtgaatataaatgagacgacagcaaaattttcatgaaatgtaaaatatttttatagtttgttcatactatatgaggttctattttaaatgactttctggattttaaaaaatttctttaaatacaatcatttttgtaatatttattttatgcttatgatctagataattgcagaatatcattttatctgactctgtcttcataagagagctgtggccgaattttgaacatctgttatagggagtgatcaaattagaaggcaatgtggaaaaacaattctgggaaagatttctttatatgaagtccctgccactagccagccatcctaattgatgaaagttatctgttcacaggcctgcagtgatggtgaggaatgttctgagatttgcgaaggcatttgagtagtgaaatgtaagcacaaaacctcctgaacccagagtgtgtatacacaggaataaactttatgacatttatgtatttttaaaaaactttgtatcgttataaaaaggctagtcattctttcaggagaacatctaggatcatagatgaaaaatcaagccccgatttagaactgtcttctccaggatggtctctaaggaaatttacatttggttctttcctactcagaactactcagaaacaactatatatttcaggttatttgagcacagtgaaagcagagtactatggttgtccaacacaggcctctcagatacaaggggaacacaattacatattgggctagattttgcccagttcaaaatagtatttgttatcaacttactttgttacttgtatcatgaattttaaaaccctaccactttaagaagacagggatgggttattcttttttggcaggtaggctatataactatgtgattttgaaatttaactgctctggattagggagcagtgaatcaaggcagacttatgaaatctgtattatatttgtaacagaatataggaaatttaacataattgatgagctcaaatcctgaaaaatgaaagaatccaaattatttcagaattatctaggttaaatattgatgtattatgatggttgcaaagtttttttgtgtgtccaataaacacattgtaaaaaaaagaatttgaattgatatctaaaaacagaatttgaattgatatttcatcttgacttttaaagccctagaggctaattgttagtaacatcaatttctattaggatatccgtttggccacacagcaggaggttagagcaatggagcattactgagttcctccccctgtcagatcagcagcagcattagattctcatagaagtgcgaaccatatggtgaactggtatgtgagggatctagagtgccatgttcctcaagagaatctaatgcctgatgatctgaggtggaacagttcatcctgaaaccattcccccatccacggaaaaattgtcttccatgaaactggtcccaaaaagggtggggaccacaggtttaaagcatggccacatttctttatattaaaattctagtttgtacatttcttttagaaacaattacatgttactttggaatcatttcttccatgcttcctccataaagactgataagtcttggatgcaatctgtaaagaaaatacattatttcatcaacttattttgttgtttttcacatacacctaataagtatggtacacaatgccaatgccaaatacaaattgataacaaacacagcattcccaacagagctgtaatctagaaaactgagaaggtctgattgataaatcatcaacaacaataattgctctaaaacctccttaactgacttccttgattgtccaatgctctccattacctctgtaaaacagtcagttatcccatgtctagtgggcacccctgcatgcttcttctaaccactgagtgtcacaatgcctaccaagaatgcgtttgcaggttcctaaacctgtttataccagttgctatgtaaaattgttcccaagggaagttgaatgctctgtaaaggcctaataaaagcaaattactgaacaaaacatgttacagtaattatgagtgagaggaaactaagatggaaggataaaaatctaacactttactattcagatggctccactaaaagatttaagatcttgatccatttttaaaaatccaaaatggaagttgtagacattatctgtagtttatgcacaacaataaattagaaagccaatgtagacacgcataaccaaagaaaatgccttgggtctacataacagttgaataaatgtaaagttgctttttatttattgaaatttgtgcatgtctctttatgcttccctgatttactgattttttaaaaactaaccaactgcctgctttgatagttcagagaagagagctttcgttgtaatattagatttatgtttactggttgacatataagcggtgaaataaatagacttacctaatatggacctctgatgcaacttccattaaatcaccatctacattccaagggaaacaattttctgaagcagtttcatcctcctcctcctctggattatatccaccagtattattccttggatgaacttttacttcctcaacagtgtaagtctcaacaaatggaaaattgaactaaaaataaatacaaataat

SEQ ID NO: 344978 - DNA, 2404 bp, Homo sapiens
actatcacacaactatttccttggatgtaattctttgttaccctttacaagtataagtgtttacaagtataagtgttaccttacatggaaacgaagaaacaaaattcataaatttaaattcataaatttagctgaaagatactgattcaatttgtatacagtgaatataaatgagacgacagcaaaattttcatgaaatgtaaaatatttttatagtttgttcatactatatgaggttctattttaaatgactttctggattttaaaaaatttctttaaatacaatcatttttgtaatatttattttatgcttatgatctagataattgcagaatatcattttatctgactctgtcttcataagagagctgtggccgaattttgaacatctgttatagggagtgatcaaattagaaggcaatgtggaaaaacaattctgggaaagatttctttatatgaagtccctgccactagccagccatcctaattgatgaaagttatctgttcacaggcctgcagtgatggtgaggaatgttctgagatttgcgaaggcatttgagtagtgaaatgtaagcacaaaacctcctgaacccagagtgtgtatacacaggaataaactttatgacatttatgtatttttaaaaaactttgtatcgttataaaaaggctagtcattctttcaggagaacatctaggatcatagatgaaaaatcaagccccgatttagaactgtcttctccaggatggtctctaaggaaatttacatttggttctttcctactcagaactactcagaaacaactatatatttcaggttatttgagcacagtgaaagcagagtactatggttgtccaacacaggcctctcagatacaaggggaacacaattacatattgggctagattttgcccagttcaaaatagtatttgttatcaacttactttgttacttgtatcatgaattttaaaaccctaccactttaagaagacagggatgggttattcttttttggcaggtaggctatataactatgtgattttgaaatttaactgctctggattagggagcagtgaatcaaggcagacttatgaaatctgtattatatttgtaacagaatataggaaatttaacataattgatgagctcaaatcctgaaaaatgaaagaatccaaattatttcagaattatctaggttaaatattgatgtattatgatggttgcaaagtttttttgtgtgtccaataaacacattgtaaaaaaaagaatttgaattgatatctaaaaacagaatttgaattgatatttcatcttgacttttaaagccctagaggctaattgttagtaacatcaatttctattaggatatccgtttggccacacagcaggaggttagagcaatggagcattactgagttcctccccctgtcagatcagcagcagcattagattctcatagaagtgcgaaccatatggtgaactggtatgtgagggatctagagtgccatgttcctcaagagaatctaatgcctgatgatctgaggtggaacagttcatcctgaaaccattcccccatccacggaaaaattgtcttccatgaaactggtcccaaaaagggtggggaccacaggtttaaagcatggccacatttctttatattaaaattctagtttgtacatttcttttagaaacaattacatgttactttggaatcatttcttccatgcttcctccataaagactgataagtcttggatgcaatctaatatggacctctgatgcaacttccattaaatcaccatctacattccaagggaaacaattttctgaagcagtttcatcctcctcctcctctggattatatccaccagtattattccttggatgaacttttacttcctcaacagtgtaagtctcaacaaatggaaaattgaactgattttttacactggcatatcttttcaggtgttttataaattctggccgagaagtgtttcgggcaattataagagccatacttccattatttaatctggtattaggtgccaagcctctaggtgccactgaacacaggcaaggaattgccataatgctgacattcaagaactgaccctggatcatttgccattgatcattacagtcagatttgggagatccctgtgccctcctttcttgcacatcatcagagctgttaaatggtaaaaatgatatttcacagtcttctgccttaagttttgccagtgccttaacaacagcaaaatctctccgttggttaggggacatccatcgatatttttctgccagagccaaagttcttccaccaaagccaaacatggctgagaacccaaagcgaagaagcttgccagcggtgctgaaggtgcagacgtcgaccagctgtacatgccc

SEQ ID NO: 344979 - DNA, 1954 bp, Homo sapiens
actatcacacaactatttccttggatgtaattctttgttaccctttacaagtataagtgtttacaagtataagtgttaccttacatggaaacgaagaaacaaaattcataaatttaaattcataaatttagctgaaagatactgattcaatttgtatacagtgaatataaatgagacgacagcaaaattttcatgaaatgtaaaatatttttatagtttgttcatactatatgaggttctattttaaatgactttctggattttaaaaaatttctttaaatacaatcatttttgtaatatttattttatgcttatgatctagataattgcagaatatcattttatctgactctgtcttcataagagagctgtggccgaattttgaacatctgttatagggagtgatcaaattagaaggcaatgtggaaaaacaattctgggaaagatttctttatatgaagtccctgccactagccagccatcctaattgatgaaagttatctgttcacaggcctgcagtgatggtgaggaatgttctgagatttgcgaaggcatttgagtagtgaaatgtaagcacaaaacctcctgaacccagagtgtgtatacacaggaataaactttatgacatttatgtatttttaaaaaactttgtatcgttataaaaaggctagtcattctttcaggagaacatctaggatcatagatgaaaaatcaagccccgatttagaactgtcttctccaggatggtctctaaggaaatttacatttggttctttcctactcagaactactcagaaacaactatatatttcaggttatttgagcacagtgaaagcagagtactatggttgtccaacacaggcctctcagatacaaggggaacacaattacatattgggctagattttgcccagttcaaaatagtatttgttatcaacttactttgttacttgtatcatgaattttaaaaccctaccactttaagaagacagggatgggttattcttttttggcaggtaggctatataactatgtgattttgaaatttaactgctctggattagggagcagtgaatcaaggcagacttatgaaatctgtattatatttgtaacagaatataggaaatttaacataattgatgagctcaaatcctgaaaaatgaaagaatccaaattatttcagaattatctaggttaaatattgatgtattatgatggttgcaaagtttttttgtgtgtccaataaacacattgtaaaaaaaagaatttgaattgatatctaaaaacagaatttgaattgatatttcatcttgacttttaaagccctagaggctaattgttagtaacatcaatttctattaggatatccgtttggccacacagcaggaggttagagcaatggagcattactgagttcctccccctgtcagatcagcagcagcattagattctcatagaagtgcgaaccatatggtgaactggtatgtgagggatctagagtgccatgttcctcaagagaatctaatgcctgatgatctgaggtggaacagttcatcctgaaaccattcccccatccacggaaaaattgtcttccatgaaactggtcccaaaaagggtggggaccacaggtttaaagcatggccacatttctttatattaaaattctagtttgtacatttcttttagaaacaattacatgttactttggaatcatttcttccatgcttcctccataaagactgataagtcttggatgcaatctaatatggacctctgatgcaacttccattaaatcaccatctacattccaagggaaacaattttctgaagcagtttcatcctcctcctcctctggattatatccaccagtattattccttggatgaacttttacttcctcaacagtgtaagtctcaacaaatggaaaattgaactaaaaataaatacaaataat

SEQ ID NO: 344980 - DNA, 2736 bp, Homo sapiens
actatcacacaactatttccttggatgtaattctttgttaccctttacaagtataagtgtttacaagtataagtgttaccttacatggaaacgaagaaacaaaattcataaatttaaattcataaatttagctgaaagatactgattcaatttgtatacagtgaatataaatgagacgacagcaaaattttcatgaaatgtaaaatatttttatagtttgttcatactatatgaggttctattttaaatgactttctggattttaaaaaatttctttaaatacaatcatttttgtaatatttattttatgcttatgatctagataattgcagaatatcattttatctgactctgtcttcataagagagctgtggccgaattttgaacatctgttatagggagtgatcaaattagaaggcaatgtggaaaaacaattctgggaaagatttctttatatgaagtccctgccactagccagccatcctaattgatgaaagttatctgttcacaggcctgcagtgatggtgaggaatgttctgagatttgcgaaggcatttgagtagtgaaatgtaagcacaaaacctcctgaacccagagtgtgtatacacaggaataaactttatgacatttatgtatttttaaaaaactttgtatcgttataaaaaggctagtcattctttcaggagaacatctaggatcatagatgaaaaatcaagccccgatttagaactgtcttctccaggatggtctctaaggaaatttacatttggttctttcctactcagaactactcagaaacaactatatatttcaggttatttgagcacagtgaaagcagagtactatggttgtccaacacaggcctctcagatacaaggggaacacaattacatattgggctagattttgcccagttcaaaatagtatttgttatcaacttactttgttacttgtatcatgaattttgctatataactatgtgattttgaaatttaactgctctggattagggagcagtgaatcaaggcagacttatgaaatctgtattatatttgtaacagaatataggaaatttaacataattgatgagctcaaatcctgaaaaatgaaagaatccaaattatttcagaattatctaggttaaatattgatgtattatgatggttgcaaagtttttttgtgtgtccaataaacacattgtaaaaaaaagaatttgaattgatatctaaaaacagaatttgaattgatatttcatcttgacttttaaagccctagaggctaattgttagtaacatcaatttctattaggatatccgtttggccacacagcaggaggttagagcaatggagcattactgagttcctccccctgtcagatcagcagcagcattagattctcatagaagtgcgaaccatatggtgaactggtatgtgagggatctagagtgccatgttcctcaagagaatctaatgcctgatgatctgaggtggaacagttcatcctgaaaccattcccccatccacggaaaaattgtcttccatgaaactggtcccaaaaagggtggggaccacaggtttaaagcatggccacatttctttatattaaaattctagtttgtacatttcttttagaaacaattacatgttactttggaatcatttcttccatgcttcctccataaagactgataagtcttggatgcaatctgtaaagaaaatacattatttcatcaacttattttgttgtttttcacatacacctaataagtatggtacacaatgccaatgccaaatacaaattgataacaaacacagcattcccaacagagctgtaatctagaaaactgagaaggtctgattgataaatcatcaacaacaataattgctctaaaacctccttaactgacttccttgattgtccaatgctctccattacctctgtaaaacagtcagttatcccatgtctagtgggcacccctgcatgcttcttctaaccactgagtgtcacaatgcctaccaagaatgcgtttgcaggttcctaaacctgtttataccagttgctatgtaaaattgttcccaagggaagttgaatgctctgtaaaggcctaataaaagcaaattactgaacaaaacatgttacagtaattatgagtgagaggaaactaagatggaaggataaaaatctaacactttactattcagatggctccactaaaagatttaagatcttgatccatttttaaaaatccaaaatggaagttgtagacattatctgtagtttatgcacaacaataaattagaaagccaatgtagacacgcataaccaaagaaaatgccttgggtctacataacagttgaataaatgtaaagttgctttttatttattgaaatttgtgcatgtctctttatgcttccctgatttactgattttttaaaaactaaccaactgcctgctttgatagttcagagaagagagctttcgttgtaatattagatttatgtttactggttgacatataagcggtgaaataaatagacttacctaatatggacctctgatgcaacttccattaaatcaccatctacattccaagggaaacaattttctgaagcagtttcatcctcctcctcctctggattatatccaccagtattattccttggatgaacttttacttcctcaacagtgtaagtctcaacaaatggaaaattgaactaaaaataaatacaaataat

SEQ ID NO: 344981 - DNA, 445 bp, Homo sapiens
ttttttaaagggagagagaaagcgatcttcggactttattgttaagtgaaaaaaagcaagatgcagacctgtgtgcattttatgctaccatttgtgtaaaataggaaatgaggtgtatttgtatttgcataacatgtttctagaaggatactcaagaaattgttggttggctgggaaacaaggaagggaggtcattttcacagtttacccttctgtgccttttggattttgcaccatattcaggtgttaaaaactcaaaacaagttttaagtattaaacatgaacagaaaaagcttcacataacaaatgccgaaaaagtcgagtgaatgaatctttcagtctgtacttaaattcttcttctgcctgggagctcgttatttcaccaagcagcccaatctctcattatgcacatccctcatcctgatgtgctgcttcgcaagatctg

SEQ ID NO: 344982 - DNA, 769 bp, Homo sapiens
ccagtattacaccaaggaaaacgttccagaaacgtcgataagccggtggtgaattactgccatcggaacatttacggcattcaaagacagaaaaaacttcatcttgaaaaatcacaatccaaaaacaacagccattcttacaccaattcataaaaaatatgtgaaccactttatccctaaatactgcaaaaacatcaaaatgagggaacagtggaacaacagagggtctttaaaagtgttattctttgtcgccctttgtttctgagtaatgctcacgatgatgctgattcaaccactgctcttctgggatcggggaccccagaaaagaacccaccgcccgagagccaaagtggaggggtgaccctcctccccttttcctgccatcagcctcccaagtagctggaactacaggcatgcctcaccatactttgccccttctacttttgtagagccaagcctgaccttcctggactgttgttttcaagcataatatctctggtacaacattgatacaatccacatgagttctttaagtaagtggctagttacttggggattcaaaggatcatcttgtctcagactttgggttcctattgtcaatacttaaattctatgataggatgccccaggaaagaaggaatacaaggccgagctgcgtggtgactttcaggggccctatttttgccttagtaggcctttctctccataaaacagttaataaaaatttcattttatagtcacattgctatgaagatgattatattaaaat

SEQ ID NO: 344983 - DNA, 400 bp, Homo sapiens
catctgaaccatcagtcactctctggcccagagaggtggtgttatttgccaaggacacacagcaggtggccaagatggagccaagccattttccccactgcagggacccctgatctccattcccctggacatctcaagggcacaaattctctggacacacggagggaataatgctgacattttatagaagctgacccactggatatccttctcacccaactccattaggctggggagagtaagaggcacggtgacaaggtggcaaagatgtcaccatgccatccaatcacgaggtctccaggaaactgtataagaaggacacctccagaaactcctggcactactgaacaaatgtataatatccctgggtaaaaccaagagtcctctcgccttctcgcca

SEQ ID NO: 344984 - DNA, 726 bp, Homo sapiens
cttctcccctttctctctcctctttactaaccaacctccagaacaattcttcttgaccgtaagtgactctgcccacctcctggtgggtttctcagctcgttctgatgggtggctcacaggggtgggaaggaaattaggttctgcaccaaatagatctaaggtactaaaatgaccctcctggacaggaggctcaagtggtaggactaaggcctaaaaccatgcaatgttttgggtttcctctgctttttcaactaaaatcagctctttcccaaagacctgcacctcccattctcctcttttcaatgtgtgtattccgagatggccttgcgtacctgccagatcatccatttccaggggcaagtctctgtctttgctttcactttgcatgccatgtgacttcttaaacaaatactccttgttattcttgtgcccacggctctctgcatatatgcagcagcagagacatgggctctcttgtagatatcccctgaaattgatacttgtttttaccctagcagctcaaataacctccagcccttctcctgcccattggcatatggctgggacagatactaattggaactctgcctttgccagttccttatgacttagtatatgctttttggtcctgttatgccccaggactgagttttttggtggctttcaaagcagattgtcagcgtgcatactggacttaaatccttaaaggactctggtcctataagg

SEQ ID NO: 344985 - DNA, 1078 bp, Homo sapiens
gttctccccacctttgcttaaccagagtcagcctcttctgttgtctgcatgggtccctgtgtgaacaggttggaggaaaggaggtgtcaaaaccgctgaactacgtgagctctgtggccccttcttactgggaagccctaggacactacagtcatggtccacacagcctgaacagctgttcctgtagatacgcatttatgctttaaaatgcctgggaaatgtgataagcatccaggttctctcccagccaccctgaccaggcagctactcctcaggagggctcaggagaacagtcccgccttcagccccaaggcgggggtgagtggtctcgggcactccgggccccacttccaggctctcctgcagggcagcagatagtggacctgcagaccccgcatggtggtcaggcagcaggtagaagaaaacagatggtgatttattgtttttgaatcttggttccacatattcccaaccagaccaagggcctttcctccttcctgccattctcccactccttttattaatacttgcacatatgtaaagctcccagtgaagtgtctggctcatcatttattgaacacaaaccatgtgctggtccctgcagtaagtgcctgacctccatcatctcagcagctgtgtgacagaggctcccttctccaggagaagacctagccccagctgcccaagagaagatcccaccggtgggaaaaggtggcagccgctggggttcccacccgttcctcctaccgtctggtgctcttacacttcagcaagtagccattttccactgtgcatttatctcttctgttccttcactcgttccttcctatattctttcatcctttgatccaagaagcttcaactgactacaatccaattccttaaggagtttctcatcagtatcttctcctaggataatttgtagctaccttctttttctaggggaaaataatgctcatagaatggttatgctgctgtaactgagacacatccttactttcctttggaataatttttcttatcatccacacttgttcaaatttcggtgtttcttgactgaaatgataggctgggcaca

SEQ ID NO: 344986 - DNA, 493 bp, Homo sapiens
agtatgatttgctgaaaagatgactttttctactgaatagtttttctacccttgttgaagataagtgaattgacaatgtaatggttgatttttggactcccaattctattcctttgatatatgtgtctatgcttatgctagtaccacactgtcttgacactgtagctttgccgtaagtgttgaaatatggaagtatgagtcttctacatttgcactctttttcaagattgtggttgctattctgggttctatgcatttacacatgaactttaggattaacatgtcaatttctacaaaaagtcatctgtaactttataggaattccatttagtttttagataaaatatggaaaattgcctgcctaagaatattgagtcttcaatccacaaacatggaatggctctctatttttatgtcttctttaatttctttcatcatgatttgttgttttcaacaaatgtacatgtcttgccattattttcttaaataaatt

SEQ ID NO: 344987 - DNA, 253 bp, Homo sapiens
ttatgaggaaaggaattagatacgtttaacccagaagaagacaggaaaggaagaacattgggggttggggagggacaattagaaaaccaacatatgaaaaagccttccatgtgaaaaattacctgaaagaaaatggactaaaaataaataacaattgaaaggcagagatgatcagactagtttaaaaatccaaaccacacatacatagtcttttcaacgagtgctggaacaaacaaatcatccatatgccaaa

SEQ ID NO: 344988 - DNA, 204 bp, Homo sapiens
gtggagtcaggattctaatccaggcaaatctgctccggatacttttgcttttagtattactaatcttcattcctgagaaaataacacattttatcaatgtccaataaactgctaaacagcccttaaatagcatttgaaactggaaggggtcttagaagttatccagtagaaaccttctactccttttctttaaagaaactgaag

SEQ ID NO: 344989 - DNA, 552 bp, Homo sapiens
cagtcatttgccaaacatctataccaacagataggcactatgattaatagggaagatgaaactgtaaacagttgtttcaaatagtgaaaggtcttataaagggccagggtgtcagggtggaagaactgattcattttgctgtagagaaaggattaatggcaagtttcacataggttgacatatttgcattgcgtctctcaagaagaggatgccataagagatacttcaggttgaagtgtactcatgtgcaaaggcatgagtatacatgtggtcacattctttaggaccagaggaaggggtgctggttttgaggggatgagaagagccaggtgatgggggcttgatggcccatgcaaactgttggacttaactgcaggtgaggaggaggctcgaaggctttaacggcagaggagtgctcttgcagcatgaggaagatggctcagacggaggcctcactgtttgtgaagagaaaaagaaagcttgccagagtccagatggtggtgacaataaggatagagagggggcagtggatttaggaggcaagcttgcctg

SEQ ID NO: 344990 - DNA, 548 bp, Homo sapiens
taaacattactttattagcaaccaagaaatgcgtattaaaaatactgaaacataatttttcagctataaaatcggcatgtattaaaaagtttaagcctacggccaggtgcgatgctcacgcctgtaatcccagcactttgggaggtcaaagcggatcacctgaggtcaggagttcgagaccagcctggccaacatggtgaaatcccgtctctactaaaaatacaaaaagttagccagtcgtggtggcaggcgcctgcaatcccagctactcgggaggctgaggcaggagaatcgcttgaacctgggaggcagaggttgcagtgagctgagatcatgccactgcactccagcctgggcaaaaagagtgaaactctgtctcaaaaaaaaaaaaaaaagtcacttaaatagcaaagtttattcttggatatccctcaatctcacttagaaacaccatagcacttaggaattctaagctgacaccagggtttactcaagattgctaacagccatgaaaagcacaactatactggacaatggatgatgggatt

SEQ ID NO: 344991 - DNA, 134 bp, Homo sapiens
cattttcgtgtaatttaatacctggaagccaagtattccttcctaagtagttttacctagtaattcttggagattctcttgtgactcatgtcatttattaaaaagggctgcattggcagcgcgtggtggctcac

SEQ ID NO: 344992 - DNA, 1009 bp, Homo sapiens
ctattataaatactttatttcaactagaaggtacaatctctcaggggtttcatagtttaaaaagctacaattacatcatgttgtaactacataaaaaacagagctgtagatggaactgcttggctttgaccatacacatttctgcacagcccttacagaatctgcacaaagaaatatctcccttttctccagttaattgttcttgtatgtaagttgctttctattccagcatacccagagtggtgaaataacaaggccagccacgtagccaaaggtcgctccaagcgtacaggagatgggccccatacctgaggagagaatgtatgagatcaaaaaagaacaaatgttttattacttgagcacaagtgtaacctaaatatttctatattaaagcttaatgtgctttcttaaaaaaaatcaggtcacagcatcctgcacttgccttgtcttgatatttgttatgcttataagtacttgtttaataactatctctcatcagattgtcaactctttaagtgtagttaccctgtcagtcttattcattgctatgtcccaagcccctattagagtacctggtacatagtgggttctgaatcaatagttgttgaaatctaaagcagatgcaacagcaatcattaattttttttaaattttaaatatgccatttatatagatgataatcattaaattttttttgagcactcattatgtgtcagtcatcgttctagcactcaggatagaatagcaaaggagacaagattcctgctctcatggagtttgtatataacctactgggaggtgtgcccaccccaggctaatggactgaagttatgaaggcaagtaactgctattggcaactcttcctacagttacatagttggaatgggagaaaaggagcattctctcaaaacatggtgatcctgttctcaaaggagagttactggacagacagagcagtaacatccaccaccagctagatgaggagtataacttcccaactgctaaaaaa

SEQ ID NO: 344993 - DNA, 368 bp, Homo sapiens
ctattataaatactttatttcaactagaaggtacaatctctcaggggtttcatagtttaaaaagctacaattacatcatgttgtaactacataaaaaacagagctgtagatggaactgcttggctttgaccatacacatttctgcacagcccttacagaatctgcacaaagaaatatctcccttttctccagttaattgttcttgtatgtaagttgctttctattccagcatacccagagtggtgaaataacaaggccagccacgtagccaaaggtcgctccaagcgtacaggagatgggcctgctcacactcgagtgtcttcttgtttttctgcaaggcacttgagaggaagtgatatagaataaaa

SEQ ID NO: 344994 - DNA, 353 bp, Homo sapiens
ctattataaatactttatttcaactagaaggtacaatctctcaggggtttcatagtttaaaaagctacaattacatcatgttgtaactacataaaaaacagagctgtagatggaactgcttggctttgaccatacacatttctgcacagcccttacagaatctgcacaaagaaatatctcccttttctccagttaattgttcttgtatgtaagttgctttctattccagcatacccagagtggtgaaataacaaggccagccacgtagccaaaggtcgctccaagcgtacaggagatgggcctgagtcaccataagctttgctacttcgttttatgaatttggaatatgataa

SEQ ID NO: 344995 - DNA, 334 bp, Homo sapiens
actactactactaaattcgcggccgcgtcgacgggacccatgttttaataatgctttatttttctccaaagaatatcttcattattttaccaagatgcataatagggaaaaattatcttatttaattgacatactgtgcctacagtgatgtgtgaggctacaaagattcaacaacctggttcagctatgttattactattgctcctcttgattagtgttaattggaatattttaattgatgcaatgtttcactgctttcacagcttgagtgagctgaagtacagagaacaatttttcaataatgaaaactaacaaaagctaccctgatattact

SEQ ID NO: 344996 - DNA, 10490 bp, Homo sapiens
  misc_feature (196)..(196): n is a, c, g, or t
ggcggcggctccggggaccggggccttttgtttggagcggctgcgggggggccccggagcggcgaggccggcggccttccccagcttgctcggtcccggccacccctcgcgggggtggggggccgccccctgggccgggcatctcctcaggcgccgccgccccgccctaggccggccccgcccggcctgaggggangaaccggccgggcctcgccgcgcggcccagccacctccggagtcgccgcctctgctctcagtgccccggatcggaggccgtccatcgcccctcgggccgacgccatgaagatcaaagatgccaagaaaccctctttcccatggtttggcatggacattgggggaactctagtaaagctctcgtactttgaacctattgatatcacagcagaggaagagcaagaagaagttgagagtttaaaaagtattcggaaatatttgacttctaacgtggcatatggatccaccggcattcgggatgtacaccttgaactgaaagatttaacactttttggccgaagagggaacttgcactttatcaggtttccaacccaggacctgcctacttttatccaaatgggaagagataaaaacttctcaacattgcagacggtgctatgtgctacaggaggtggtgcttacaagtttgaaaaagattttcgcacaattggaaacctccacctgcacaaactggatgaacttgactgccttgtaaagggcttgctgtatatagactctgtcagtttcaatggacaagccgagtgctattattttgctaatgcctcagaacctgagcgatgccaaaagatgccttttaacctggatgatccctatccactgcttgtagtgaacattggctcaggagtcagtattttagcagtccattccaaagacaactataaacgagtgactgggacaagccttggagggggtacctttctgggtttatgcagtttattgactggctgtgaaagttttgaagaggctcttgaaatggcatccaaaggtgatagcacacaagctgacaagctggtccgtgatatttatggaggagattatgaaagatttggtttgccaggttgggctgtagcatctagttttgggaatatgatttataaggagaagcgagaatctgttagtaaagaagatctggcaagagctactttagttactatcaccaataacattggttctgtggcacgaatgtgtgctgttaatgagaaaataaacagagttgtctttgttggaaactttttacgtgtcaataccctctcaatgaaacttttggcatatgcactggattactggtcaaaaggtcaactaaaagcattgtttctagaacatgagggttactttggagcagttggtgcacttcttgggctgccaaatttcagctaaagcatcaggtctctctctctgctaataaatgtcatccaagaggaactaaaaccagaggcattattactgcattgtttgtcactgggaaccaaaggataaaagagtagcataagctgctgaatgttgccatattaaaggagagaacttggtaacgtgaagtatttctcattgaaatgctttcccttttgtatatagccagtgttaaatccttaaatgcaatacagcctctgattattgagcttcctcttaaaaagatttttttattttatgtagccaacattgcagtactgtatgctcaaacacaaatcttaaagtatcggaactgtttagcttatgaaaataatcgactctgaatatttgttacaagtctgttttatgtgttttgattactagtgagcagaaaataacataccctgtattcaaaattactgaaatggcaatcaaagatgatcatttttatgtgattttagaaatgttaaggcaatactactaattattgtaggtttttttaacgtatcacccaaagcatgtatgtgatctttccccattagtatctttttctcaaatgccataattaactgaaatactattattaaattttcatgagaattctaaaatgaatcctgggaaatgcacgtttggtgatgttgcactttctgtattttacaggaattagtcaatacatgttgaaatgtttaacattttaagattggaggcttaattactgggagtctgtctaatgaagtcctgggactattgtaatggaatatgatttgagttcactgtgctctttttgtttgtttgttttggtcatatatacattcagaacttttattttaaaacaaccacaataacattaataatagaaaattcatctgtaaatattcacagtctagtcactgaaaaatgggaaaacctctaccatgccttattattaccctttgctgtttgaggagccagaaatagaggtgcagttagaggacggtcactttttccaacaaaacccactccatagccatgtggatttttatccaaaggctcaacaaccagagggaatggtgagacctgataactaaaatactgttattggcaagggtttgaaatgtgtaagaacctaggagggaaaggaagattgagcaacataggaaaaggggaagagaggctgagtgtcaccaaggtccaaactccatttataaaaatactgcaaaaccaggagttgatggtagaagtgcatatgatccatggcaggagtaaatctctccacctcctctaactctctgaaaactctagagttggagcaagtcttccatttgcttcttatccccttaaaagaatgccttccacttcccaacagcccccatcaagggaccccaagaggccaccatgctcttatctcgcactttctttcctattccccttgcctgaatctggagtggggttgagccctctgccttcaaccttaagatttaggaagttctttccccaactgtctaacttggaaaggtagatgagtctgaattttgaagtaacgaatgcaaattccactcagcagaggcaatgttatttatgtacatagggatagtggaatgagttttaatagattctgtccaaaaggggtttgttcctcttatttcctctatgtaggaagttgtgtcttaggcaactttatcagtatcaatggaaaaatgataggcactacaatgaaatggcaggatgccaatatgagatatttcaggaataataagaaatacagtttgtttgtataaaataaactatctcaagaaagttttcaacgacagtgatagtgttcatttgtaagagagagttctagaacttcgatgtccagtgcagtagccactacccatatgtagctgttgagcatttgaaatatggttagtccaaattgagatgtgctctaaaggacaataaaaggttaaatatctcctaattttttgtattgattacatgttgaaatgttaacattggaaatattgggttaaagaaaaatacacaattaaaatgaatcttggccaggcgcagtggctcacgcctctaatcccagcactttgagaggccagggtgggcaggtcacctgaggtcaggagttcgagaccagcctggccagtgtggcaaaaccctgcctactaaaaatacaaaaattagccaggcatggtggtgcgcacctgtagtcccagctacttgggaggctgaggcaggagaattgcttgaacccaggaggaggaggctgcagtgagctgagattgtgccactgcactccagcctgggcgacagagtgagactctgtctcaaaaaaaagaatcatctgtttccaattatttttaaatgtgcttactagaaaagataaaatcacacatggtttacattttatttctattaagacagcaccgttaagaacatagagctttgaggaattgtggtattagaaccaaatctatttaccacagtgagcttacagggagttactcgagatcttaataaaaaattataatctttggcagccttcattatgattttgtgttcttattattccagtacctctagattacatatgggaaaagctaaagagccacagtggtgagatggttgctcactctagcaggtaatttcagtttgaaaggataaaatatatgaatcatagttcacattaaccaaagtacagtgatgaaataacttagactctgaccattccatttttttcttaaagattgccctaaatctatagatgctaatacagtatttgccacaggtataaaacttgtagttactgtcattcaattaagattcttatctgtacagatatacaaatcagaaacttttaaaataaattgaactaatggaattttggctccaatatttagtcactacaatggaaatattaaagcaaggaacatgaagtcattgtagggttttaaaatggctactgactgacatgaattcagagtttcaaacagtctaaattctaaaaacttaactttacacgcttttcctcctaaataaccactctaataattcatacattcatatcttcaggtaaagaaaactgaattttaaacaattgaggctgggtgcagtggctcatgcctgtaatcgaatataaggacttgagtataaaatttgaaaactacatggggaaatgtctttatcatgcatctcttgatagtctactgaaaactattaagtaaacctgcggtctgtaaacaaaaaaacccatagtgatacttaccttgtgtaatgtaaacaattttttaagctctttaaagtacatctagatttactggtaatgtatagaagtcaattttatccccaagcatttctacttcctaaaccattagcaagagtctcaaaacaacttcactaaactattggacctccagtgttaacttgccaacataaaaatctgaaaaactttgtaatcactatcaaaaatacaaaagagagaataaattcccaggtaaaaggctttacaaattttggaactattatgcttttgtttactaaacactgatccttttagtaattctgcagtattgcctcagactcccacaaagtttcaaaatagctcatctattagattcctgtaacatttatttgggataaacgtggttttgttgccgttgttcataatagaataaaatatttagctttgatggttcagatgtaatacaaagaaataactaagtttgggcctgagataaatgtggtaaagcaagaatgcagagatgctgtaatgatgagtgagttttatagcattactgaggacctgaaaacttgctgccaaggacactttgaaggttttgttggctggaagaagtgtctctggaatcccactcctagctcttcttgaatatttgaaaagaattagataagggccatggggacccaggtcaccccacctcttcttttcagtttggctacaacattggagtcatcagtgctcctgagacagtcatacaggactttctcagttacactttgaaagagaggtcagaagactctccctctgaggttttgctcatgtccccctggcccttgtctgtggccatcttccccaatggtgatatgattggctcctttctgttgcactctttgtcaaccactttggcaggtgcagttcaatgcttatcataatttgttggctattactggttgccttatgggattctgcagacaagctgagttggttgaaatgctgatcctgggccactagattactggcttgtaatgcggactctgcacaagttttgtgcccatgtacattggagagatctcgcctactcccctttggggtacctttagtgctctcaaccagctggacgtcgttggtattctggagatccagatctttggtctggagttcatcttggggtctgaagagctatgcccagtgatactgggctttaccatccttccagctgtcctataaagtgtagcccttccattttgccctggaagtcgtaagtttttgctcattaacagaaaggaagagtactaatgagatccttcagcaattgtaggggactcaggatgtgtcccaggacatctaggagataagagtgctaggatgatacaagcaaagcaagtcactacactggcgctctttagagtacccagctaccaacaacccactgtcatttccatcatgctccagctctctcagtagctctctggaatcaatgttgtcttctattactcaatgagaatcttcaaggatgcaggtgttgagaagccaatctatagattagtgcaggagtggttaatattatcttcttgactgtagtctctctgtttgtggttgaaagggcaggaaggactttacatatgataggtcttgaggcatggcgttttgttctgtcctcatgattgtttctttgttattaaaggatgagtatggtgggatgagctttgtctgtagtggggctatcttggtctttgtggccttctctgaagttggaccagactccgttccctggaatactgtggccacactcttcagtttgcaatagcagtggctggttgctccaactggacctccaactttctagttggattgctcttcctgaacaattattatctagtttaagtgtgttgttgctttagggtcatggcatgcttatgtatttctgttaccatctgaccatggtactatgccaagttctcttaggggacctgaatctttccagtagaccacatttgagagagtatgagtcaactgggcatagttcccaacaacccaaaatacatacgtacttcactgaagcagatctcatgattccattgacttcatttctaaaattggactttgagcagccaatttctaaggattaaaaagaaactttaatgcattgtagacctctgtacacagaaaaatctttgtaacttttgggcttaattttcattcttaaaaaatctggtaactttttcaaatgcaaccactgtcagtttgctgtgaggctaggcaaacaacacaaggtatagaatttcccatcaccaccaccctgaccccgcgagaagattgccttttaattagagacttgtagaactagtgccttttaagttctacactcatcttttccaaagactattagtaaacttgccatgtaatttgacatggcagttccttgctcagctactctaaataaagttggaaattaggtggtctcttagtttgggtaaagtcagtactattgccagtaatatacatggtaattgaaagcccttaaagtggttcagattatttgccaaatattagactctataaaaatttctgaggttttttttcttttacctttgagtgtacatgtgattgctataatgtaaataccagtcccttaaagactgtttctataagcagaatgatgcagcacaaagtggaaaggttttcctcttattccagcagtattcttgccttcaaagagtagtccatcttgccttgatttttaaggttgttttcttggatggaaagcttaactggatagtaatttccatatgttctttataaccactctgtatattataagcaaagttttttcatattgtatctttttctgttgagcactttatgcattttagtctattgcatttgagaatgtagtttagaaattcactgtttaaagccatgtgaaaactgatagaggataatgaaaatgagtgtacattattttgaatttaacttaactgttttgtggtgggtgtgaacaaaacattagaaatatattatctttttgtgataatactctctgacctcacttaaagtgatctgccatgaggtatccatgatcaagtttatgtttattctaatacctaaggaattcagccaactttgtttctatcatcagataatctcagaaaatagtgtgttttatctatattactgcctcttttcaatatttaagagaataattgtcttctggtttctactgagcctagtaataatcactaaagacctaaaaaaggaattccttctgttaagagtatttggatagcccattcacgataatggtggtgtgaaaatcaatcatcccagcttttctgacatatctaaattttgaataattaatttccacttccaaaaaattcaaatgttttctcaaagcagtcactacttatttgcattattcctgcatattcagtgaatgtgaggtcatatttggtattgtattagaagtagtgttggtcactggtcttgcctctttgaacattatttttatttgtaaaatgagggagttggtttgttatgatgggaaatgagtcagttttcagggtcctgagaaaattgcttcattcatggctgtgtttgagataactaaagtaaattttttttcaggtatttggtgtcatgttttggagttaatatttagtgcttatataattttaagttattacataatttttattggtatatatttgataggtactaggtattggattctcaccaaaccagtagaatggtattctctcttaatatgtgattgcctgtaatggccaggtagatataccttaaagtaatatgaaaggttttatatgtatattaaaatgtttgtacttttaaatctgtaaaggttatctggaatttttactgtgttaacttcagaattatatgggcattatgactttttcattgtacaaaaaattattcataaatgttagaatacagatgttccttgacttacaatagggttatgttccagtagacccattgtaaattgaaaataccgtaagttgaaaatacatttaatacgcctaacctactgaacatcccagcttagcctagcctatcttaaatgtgttctgaacacttaacgttggcctttagctgggcaaaatcatctaatacaaaacctattttataatgaagtgtttaatatctcaaataagagtattgtaccacatatcgttatcccaggataatatcagagtacaaaatttgaagtacagtttttaactgaatgtgtattgcttttgccccattataaagttgaaaaaccataagtcaaaccattgttaagtcggactgtttgtgttacatatatttgggattttttagtggccctttttaaaaagctgtttcttatttctgatcattgtgagtggggatagatgtgggaagaaccatgtctctactaaaaatacaaaaaatagccaggcttgttggcacacacctatagtcccagctactcgggagaccgaggcaggagaatcacttgaaccgggaggcagagggcagatcatgccactgtattccagcctgggcaacagagtaagactctgtctcaaaaatgaatgaatgaatgaatgaacgaatgaatgtactatgagctgatactgggatttcaggtaccgcagtttgtgctgaatgatatgtttggggtaaatcagtttttttcttatagaatttcggcgtttttgctgcaactgccactaattttgcatttaaaagaacaaaagaggaatgtatttttcaaaggagtgaatgaggttaaaatcaagattttgaatggtataaatatgcaactaattcagttgtaggatattattaaattttttattgctaaatatgtttctttcatacgttgcagtgcttacagttccaacagctttccaagaaaacatttccatatttgtgttatttgtaaagtatacataaataatgtaaaataatttgggattatttcaactttacattgtatgtctgaatttcatcgatgttgtacctggctcagtcaatagttgtcacaggtattaagccattttggaatttgccacttttttctgggtaacctgttttagtttagtttacagcatttagaaacagaaggtaactttatagaagtaacaccaatatcctagtctgcttgccccgaatataactaatagtattaggatgtaagcaatattaagatggtttttattattttttatacactgtgtgcttttactttttatttaaactacagcaaaaaactgattttttaactaaaattgaatggcgtttatcttaatgaccagttattgaccaaagtgtactcagaagatgttattatgtcccaatctaaggaatcctttaatttggggattaattttacttacacatgccatttcagtttcagttgcctcattctattacatcattcttgtcaagtctaagctttatcatgtctgaattcttttaacactgaatctgtgatgtaaaaatgtatgatgtgccataaattttattcataataaactaagttatagcctattgtaatctgtaaaacatttcttgtaaattacctaatttattttttcatttatgtacagtatcttatgtaaatttgaaaaatgtttgccatggcgcattctgtaaacattcccgtattcttttccttaatgcttatttgcatgaaggtaacttgggttttgcttgtttgtattggataaccattaagccaacttcagtttctctgcctttttttctgtagtttaaccatttctaattttgttcatattctaaatagatgttagaatcatactttttattttctactttctaaataaattatctaagttgtttacta

SEQ ID NO: 344997 - DNA, 10436 bp, Homo sapiens
  misc_feature (196)..(196): n is a, c, g, or t
ggcggcggctccggggaccggggccttttgtttggagcggctgcgggggggccccggagcggcgaggccggcggccttccccagcttgctcggtcccggccacccctcgcgggggtggggggccgccccctgggccgggcatctcctcaggcgccgccgccccgccctaggccggccccgcccggcctgaggggangaaccggccgggcctcgccgcgcggcccagccacctccggagtcgccgcctctgctctcagtgccccggatcggaggccgtccatcgcccctcgggccgacgccatgaagatcaaagatgccaagaaaccctctttcccatggtttggcatggacattgggggaactctagtaaagctctcgtactttgaacctattgatatcacagcagaggaagagcaagaagaagttgagagtttaaaaagtattcggaaatatttgacttctaacgtggcatatggatccaccggcattcgggatgtacaccttgaactgaaagatttaacactttttggccgaagagggaacttgcactttatcaggtttccaacccaggacctgcctacttttatccaaatgggaagagataaaaacttctcaacattgcagacggtgctatgtgctacaggaggtggtgcttacaagtttgaaaaagattttcgcacaattggaaacctccacctgcacaaactggatgaacttgactgccttgtaaagggcttgctgtatatagactctgtcagtttcaatggacaagccgagtgctattattttgctaatgcctcagaacctgagcgatgccaaaagatgccttttaacctggatgatccctatccactgcttgtagtgaacattggctcaggagtcagtattttagcagtccattccaaagacaactataaacgagtgactgggacaagccttggagggggtacctttctgggtttatgcagtttattgactggctgtgaaagttttgaagaggctcttgaaatggcatccaaaggtgatagcacacaagctgacaagctggtccgtgatatttatggaggagattatgaaagatttggtttgccaggttgggctgtagcatctagttttgggaatatgatttataaggagaagcgagaatctgttagtaaagaagatctggcaagagctactttagttactatcaccaataacattggttctgtggcacgaatgtgtgctgttaatgagaaaataaacagagttgtctttgttggaaactttttacgtgtcaataccctctcaatgaaacttttggcatatgcactggattactggtcaaaaggtcaactaaaagcattgtttctagaacatgagggttactttggagcagttggtgcacttcttgggctgccaaatttcagctaaagcatcaggtctctctctctgctaataaatgtcatccaagaggaactaaaaccagaggcattattactgcattgtttgtcactgggaaccaaaggataaaagagtagcataagctgctgaatgttgccatattaaaggagagaacttggtaacgtgaagtatttctcattgaaatgctttcccttttgtatatagccagtgttaaatccttaaatgcaatacagcctctgattattgagcttcctcttaaaaagatttttttattttatgtagccaacattgcagtactgtatgctcaaacacaaatcttaaagtatcggaactgtttagcttatgaaaataatcgactctgaatatttgttacaagtctgttttatgtgttttgattactagtgagcagaaaataacataccctgtattcaaaattactgaaatggcaatcaaagatgatcatttttatgtgattttagaaatgttaaggcaatactactaattattgtaggtttttttaacgtatcacccaaagcatgtatgtgatctttccccattagtatctttttctcaaatgccataattaactgaaatactattattaaattttcatgagaattctaaaatgaatcctgggaaatgcacgtttggtgatgttgcactttctgtattttacaggaattagtcaatacatgttgaaatgtttaacattttaagattggaggcttaattactgggagtctgtctaatgaagtcctgggactattgtaatggaatatgatttgagttcactgtgctctttttgtttgtttgttttggtcatatatacattcagaacttttattttaaaacaaccacaataacattaataatagaaaattcatctgtaaatattcacagtctagtcactgaaaaatgggaaaacctctaccatgccttattattaccctttgctgtttgaggagccagaaatagaggtgcagttagaggacggtcactttttccaacaaaacccactccatagccatgtggatttttatccaaaggctcaacaaccagagggaatggtgagacctgataactaaaatactgttattggcaagggtttgaaatgtgtaagaacctaggagggaaaggaagattgagcaacataggaaaaggggaagagaggctgagtgtcaccaaggtccaaactccatttataaaaatactgcaaaaccaggagttgatggtagaagtgcatatgatccatggcaggagtaaatctctccacctcctctaactctctgaaaactctagagttggagcaagtcttccatttgcttcttatccccttaaaagaatgccttccacttcccaacagcccccatcaagggaccccaagaggccaccatgctcttatctcgcactttctttcctattccccttgcctgaatctggagtggggttgagccctctgccttcaaccttaagatttaggaagttctttccccaactgtctaacttggaaaggtagatgagtctgaattttgaagtaacgaatgcaaattccactcagcagaggcaatgttatttatgtacatagggatagtggaatgagttttaatagattctgtccaaaaggggtttgttcctcttatttcctctatgtaggaagttgtgtcttaggcaactttatcagtatcaatggaaaaatgataggcactacaatgaaatggcaggatgccaatatgagatatttcaggaataataagaaatacagtttgtttgtataaaataaactatctcaagaaagttttcaacgacagtgatagtgttcatttgtaagagagagttctagaacttcgatgtccagtgcagtagccactacccatatgtagctgttgagcatttgaaatatggttagtccaaattgagatgtgctctaaaggacaataaaaggttaaatatctcctaattttttgtattgattacatgttgaaatgttaacattggaaatattgggttaaagaaaaatacacaattaaaatgaatcttggccaggcgcagtggctcacgcctctaatcccagcactttgagaggccagggtgggcaggtcacctgaggtcaggagttcgagaccagcctggccagtgtggcaaaaccctgcctactaaaaatacaaaaattagccaggcatggtggtgcgcacctgtagtcccagctacttgggaggctgaggcaggagaattgcttgaacccaggaggaggaggctgcagtgagctgagattgtgccactgcactccagcctgggcgacagagtgagactctgtctcaaaaaaaagaatcatctgtttccaattatttttaaatgtgcttactagaaaagataaaatcacacatggtttacattttatttctattaagacagcaccgttaagaacatagagctttgaggaattgtggtattagaaccaaatctatttaccacagtgagcttacagggagttactcgagatcttaataaaaaattataatctttggcagccttcattatgattttgtgttcttattattccagtacctctagattacatatgggaaaagctaaagagccacagtggtgagatggttgctcactctagcaggtaatttcagtttgaaaggataaaatatatgaatcatagttcacattaaccaaagtacagtgatgaaataacttagactctgaccattccatttttttcttaaagattgccctaaatctatagatgctaatacagtatttgccacaggtataaaacttgtagttactgtcattcaattaagattcttatctgtacagatatacaaatcagaaacttttaaaataaattgaactaatggaattttggctccaatatttagtcactacaatggaaatattaaagcaaggaacatgaagtcattgtagggttttaaaatggctactgactgacatgaattcagagtttcaaacagtctaaattctaaaaacttaactttacacgcttttcctcctaaataaccactctaataattcatacattcatatcttcaggtaaagaaaactgaattttaaacaattgaggctgggtgcagtggctcatgcctgtaatcgaatataaggacttgagtataaaatttgaaaactacatggggaaatgtctttatcatgcatctcttgatagtctactgaaaactattaagtaaacctgcggtctgtaaacaaaaaaacccatagtgatacttaccttgtgtaatgtaaacaattttttaagctctttaaagtacatctagatttactggtaatgtatagaagtcaattttatccccaagcatttctacttcctaaaccattagcaagagtctcaaaacaacttcactaaactattggacctccagtgttaacttgccaacataaaaatctgaaaaactttgtaatcactatcaaaaatacaaaagagagaataaattcccaggtaaaaggctttacaaattttggaactattatgcttttgtttactaaacactgatccttttagtaattctgcagtattgcctcagactcccacaaagtttcaaaatagctcatctattagattcctgtaacatttatttgggataaacgtggttttgttgccgttgttcataatagaataaaatatttagctttgatggttcagatgtaatacaaagaaataactaagtttgggcctgagataaatgtggtaaagcaagaatgcagagatgctgtaatgatgagtgagttttatagcattactgaggacctgaaaacttgctgccaaggacactttgaaggttttgttggctggaagaagtgtctctggaatcccactcctagctcttcttgaatatttgaaaagaattagataagggccatggggacccaggtcaccccacctcttcttttcagtttggctacaacattggagtcatcagtgctcctgagacagtcatacaggactttctcagttacactttgaaagagaggtcagaagactctccctctgaggttttgctcatgtccccctggcccttgtctgtggccatcttccccaatggtgatatgattggctcctttctgttgcactctttgtcaaccactttggcaggtgcagttcaatgcttatcataatttgttggctattactggttgccttatgggattctgcagacaagctgagttggttgaaatgctgatcctgggccactagattactggcttgtaatgcggactctgcacaagttttgtgcccatgtacattggagagatctcgcctactcccctttggggtacctttagtgctctcaaccagctggacgtcgttggtattctggagatccagatctttggtctggagttcatcttggggtctgaagagctatgcccagtgatactgggctttaccatccttccagctgtcctataaagtgtagcccttccattttgccctggaagtcgtaagtttttgctcattaacagaaaggaagagtactaatgagatccttcagcaattgtaggggactcaggatgtgtcccaggacatctaggagataagagtgctaggatgatacaagctgtcatttccatcatgctccagctctctcagtagctctctggaatcaatgttgtcttctattactcaatgagaatcttcaaggatgcaggtgttgagaagccaatctatagattagtgcaggagtggttaatattatcttcttgactgtagtctctctgtttgtggttgaaagggcaggaaggactttacatatgataggtcttgaggcatggcgttttgttctgtcctcatgattgtttctttgttattaaaggatgagtatggtgggatgagctttgtctgtagtggggctatcttggtctttgtggccttctctgaagttggaccagactccgttccctggaatactgtggccacactcttcagtttgcaatagcagtggctggttgctccaactggacctccaactttctagttggattgctcttcctgaacaattattatctagtttaagtgtgttgttgctttagggtcatggcatgcttatgtatttctgttaccatctgaccatggtactatgccaagttctcttaggggacctgaatctttccagtagaccacatttgagagagtatgagtcaactgggcatagttcccaacaacccaaaatacatacgtacttcactgaagcagatctcatgattccattgacttcatttctaaaattggactttgagcagccaatttctaaggattaaaaagaaactttaatgcattgtagacctctgtacacagaaaaatctttgtaacttttgggcttaattttcattcttaaaaaatctggtaactttttcaaatgcaaccactgtcagtttgctgtgaggctaggcaaacaacacaaggtatagaatttcccatcaccaccaccctgaccccgcgagaagattgccttttaattagagacttgtagaactagtgccttttaagttctacactcatcttttccaaagactattagtaaacttgccatgtaatttgacatggcagttccttgctcagctactctaaataaagttggaaattaggtggtctcttagtttgggtaaagtcagtactattgccagtaatatacatggtaattgaaagcccttaaagtggttcagattatttgccaaatattagactctataaaaatttctgaggttttttttcttttacctttgagtgtacatgtgattgctataatgtaaataccagtcccttaaagactgtttctataagcagaatgatgcagcacaaagtggaaaggttttcctcttattccagcagtattcttgccttcaaagagtagtccatcttgccttgatttttaaggttgttttcttggatggaaagcttaactggatagtaatttccatatgttctttataaccactctgtatattataagcaaagttttttcatattgtatctttttctgttgagcactttatgcattttagtctattgcatttgagaatgtagtttagaaattcactgtttaaagccatgtgaaaactgatagaggataatgaaaatgagtgtacattattttgaatttaacttaactgttttgtggtgggtgtgaacaaaacattagaaatatattatctttttgtgataatactctctgacctcacttaaagtgatctgccatgaggtatccatgatcaagtttatgtttattctaatacctaaggaattcagccaactttgtttctatcatcagataatctcagaaaatagtgtgttttatctatattactgcctcttttcaatatttaagagaataattgtcttctggtttctactgagcctagtaataatcactaaagacctaaaaaaggaattccttctgttaagagtatttggatagcccattcacgataatggtggtgtgaaaatcaatcatcccagcttttctgacatatctaaattttgaataattaatttccacttccaaaaaattcaaatgttttctcaaagcagtcactacttatttgcattattcctgcatattcagtgaatgtgaggtcatatttggtattgtattagaagtagtgttggtcactggtcttgcctctttgaacattatttttatttgtaaaatgagggagttggtttgttatgatgggaaatgagtcagttttcagggtcctgagaaaattgcttcattcatggctgtgtttgagataactaaagtaaattttttttcaggtatttggtgtcatgttttggagttaatatttagtgcttatataattttaagttattacataatttttattggtatatatttgataggtactaggtattggattctcaccaaaccagtagaatggtattctctcttaatatgtgattgcctgtaatggccaggtagatataccttaaagtaatatgaaaggttttatatgtatattaaaatgtttgtacttttaaatctgtaaaggttatctggaatttttactgtgttaacttcagaattatatgggcattatgactttttcattgtacaaaaaattattcataaatgttagaatacagatgttccttgacttacaatagggttatgttccagtagacccattgtaaattgaaaataccgtaagttgaaaatacatttaatacgcctaacctactgaacatcccagcttagcctagcctatcttaaatgtgttctgaacacttaacgttggcctttagctgggcaaaatcatctaatacaaaacctattttataatgaagtgtttaatatctcaaataagagtattgtaccacatatcgttatcccaggataatatcagagtacaaaatttgaagtacagtttttaactgaatgtgtattgcttttgccccattataaagttgaaaaaccataagtcaaaccattgttaagtcggactgtttgtgttacatatatttgggattttttagtggccctttttaaaaagctgtttcttatttctgatcattgtgagtggggatagatgtgggaagaaccatgtctctactaaaaatacaaaaaatagccaggcttgttggcacacacctatagtcccagctactcgggagaccgaggcaggagaatcacttgaaccgggaggcagagggcagatcatgccactgtattccagcctgggcaacagagtaagactctgtctcaaaaatgaatgaatgaatgaatgaacgaatgaatgtactatgagctgatactgggatttcaggtaccgcagtttgtgctgaatgatatgtttggggtaaatcagtttttttcttatagaatttcggcgtttttgctgcaactgccactaattttgcatttaaaagaacaaaagaggaatgtatttttcaaaggagtgaatgaggttaaaatcaagattttgaatggtataaatatgcaactaattcagttgtaggatattattaaattttttattgctaaatatgtttctttcatacgttgcagtgcttacagttccaacagctttccaagaaaacatttccatatttgtgttatttgtaaagtatacataaataatgtaaaataatttgggattatttcaactttacattgtatgtctgaatttcatcgatgttgtacctggctcagtcaatagttgtcacaggtattaagccattttggaatttgccacttttttctgggtaacctgttttagtttagtttacagcatttagaaacagaaggtaactttatagaagtaacaccaatatcctagtctgcttgccccgaatataactaatagtattaggatgtaagcaatattaagatggtttttattattttttatacactgtgtgcttttactttttatttaaactacagcaaaaaactgattttttaactaaaattgaatggcgtttatcttaatgaccagttattgaccaaagtgtactcagaagatgttattatgtcccaatctaaggaatcctttaatttggggattaattttacttacacatgccatttcagtttcagttgcctcattctattacatcattcttgtcaagtctaagctttatcatgtctgaattcttttaacactgaatctgtgatgtaaaaatgtatgatgtgccataaattttattcataataaactaagttatagcctattgtaatctgtaaaacatttcttgtaaattacctaatttattttttcatttatgtacagtatcttatgtaaatttgaaaaatgtttgccatggcgcattctgtaaacattcccgtattcttttccttaatgcttatttgcatgaaggtaacttgggttttgcttgtttgtattggataaccattaagccaacttcagtttctctgcctttttttctgtagtttaaccatttctaattttgttcatattctaaatagatgttagaatcatactttttattttctactttctaaataaattatctaagttgtttacta

SEQ ID NO: 344998 - DNA, 9939 bp, Homo sapiens
  misc_feature (196)..(196): n is a, c, g, or t
  misc_feature (9867)..(9867): n is a, c, g, or t
  misc_feature (9869)..(9869): n is a, c, g, or t
  misc_feature (9872)..(9872): n is a, c, g, or t
  misc_feature (9874)..(9874): n is a, c, g, or t
  misc_feature (9877)..(9877): n is a, c, g, or t
ggcggcggctccggggaccggggccttttgtttggagcggctgcgggggggccccggagcggcgaggccggcggccttccccagcttgctcggtcccggccacccctcgcgggggtggggggccgccccctgggccgggcatctcctcaggcgccgccgccccgccctaggccggccccgcccggcctgaggggangaaccggccgggcctcgccgcgcggcccagccacctccggagtcgccgcctctgctctcagtgccccggatcggaggccgtccatcgcccctcgggccgacgccatgaagatcaaagatgccaagaaaccctctttcccatggtttggcatggacattgggggaactctagtaaagctctcgtactttgaacctattgatatcacagcagaggaagagcaagaagaagttgagagtttaaaaagtattcggaaatatttgacttctaacgtggcatatggatccaccggcattcgggatgtacaccttgaactgaaagatttaacactttttggccgaagagggaacttgcactttatcaggtttccaacccaggacctgcctacttttatccaaatgggaagagataaaaacttctcaacattgcagacggtgctatgtgctacaggaggtggtgcttacaagtttgaaaaagattttcgcacaattggaaacctccacctgcacaaactggatgaacttgactgccttgtaaagggcttgctgtatatagactctgtcagtttcaatggacaagccgagtgctattattttgctaatgcctcagaacctgagcgatgccaaaagatgccttttaacctggatgatccctatccactgcttgtagtgaacattggctcaggagtcagtattttagcagtccattccaaagacaactataaacgagtgactgggacaagccttggagggggtacctttctgggtttatgcagtttattgactggctgtgaaagttttgaagaggctcttgaaatggcatccaaaggtgatagcacacaagctgacaagctggtccgtgatatttatggaggagattatgaaagatttggtttgccaggttgggctgtagcatctagttttgggaatatgatttataaggagaagcgagaatctgttagtaaagaagatctggcaagagctactttagttactatcaccaataacattggttctgtggcacgaatgtgtgctgttaatgagaaaataaacagagttgtctttgttggaaactttttacgtgtcaataccctctcaatgaaacttttggcatatgcactggattactggtcaaaaggtcaactaaaagcattgtttctagaacatgagggttactttggagcagttggtgcacttcttgggctgccaaatttcagctaaagcatcaggtctctctctctgctaataaatgtcatccaagaggaactaaaaccagaggcattattactgcattgtttgtcactgggaaccaaaggataaaagagtagcataagctgctgaatgttgccatattaaaggagagaacttggtaacgtgaagtatttctcattgaaatgctttcccttttgtatatagccagtgttaaatccttaaatgcaatacagcctctgattattgagcttcctcttaaaaagatttttttattttatgtagccaacattgcagtactgtatgctcaaacacaaatcttaaagtatcggaactgtttagcttatgaaaataatcgactctgaatatttgttacaagtctgttttatgtgttttgattactagtgagcagaaaataacataccctgtattcaaaattactgaaatggcaatcaaagatgatcatttttatgtgattttagaaatgttaaggcaatactactaattattgtaggtttttttaacgtatcacccaaagcatgtatgtgatctttccccattagtatctttttctcaaatgccataattaactgaaatactattattaaattttcatgagaattctaaaatgaatcctgggaaatgcacgtttggtgatgttgcactttctgtattttacaggaattagtcaatacatgttgaaatgtttaacattttaagattggaggcttaattactgggagtctgtctaatgaagtcctgggactattgtaatggaatatgatttgagttcactgtgctctttttgtttgtttgttttggtcatatatacattcagaacttttattttaaaacaaccacaataacattaataatagaaaattcatctgtaaatattcacagtctagtcactgaaaaatgggaaaacctctaccatgccttattattaccctttgctgtttgaggagccagaaatagaggtgcagttagaggacggtcactttttccaacaaaacccactccatagccatgtggatttttatccaaaggctcaacaaccagagggaatggtgagacctgataactaaaatactgttattggcaagggtttgaaatgtgtaagaacctaggagggaaaggaagattgagcaacataggaaaaggggaagagaggctgagtgtcaccaaggtccaaactccatttataaaaatactgcaaaaccaggagttgatggtagaagtgcatatgatccatggcaggagtaaatctctccacctcctctaactctctgaaaactctagagttggagcaagtcttccatttgcttcttatccccttaaaagaatgccttccacttcccaacagcccccatcaagggaccccaagaggccaccatgctcttatctcgcactttctttcctattccccttgcctgaatctggagtggggttgagccctctgccttcaaccttaagatttaggaagttctttccccaactgtctaacttggaaaggtagatgagtctgaattttgaagtaacgaatgcaaattccactcagcagaggcaatgttatttatgtacatagggatagtggaatgagttttaatagattctgtccaaaaggggtttgttcctcttatttcctctatgtaggaagttgtgtcttaggcaactttatcagtatcaatggaaaaatgataggcactacaatgaaatggcaggatgccaatatgagatatttcaggaataataagaaatacagtttgtttgtataaaataaactatctcaagaaagttttcaacgacagtgatagtgttcatttgtaagagagagttctagaacttcgatgtccagtgcagtagccactacccatatgtagctgttgagcatttgaaatatggttagtccaaattgagatgtgctctaaaggacaataaaaggttaaatatctcctaattttttgtattgattacatgttgaaatgttaacattggaaatattgggttaaagaaaaatacacaattaaaatgaatcttggccaggcgcagtggctcacgcctctaatcccagcactttgagaggccagggtgggcaggtcacctgaggtcaggagttcgagaccagcctggccagtgtggcaaaaccctgcctactaaaaatacaaaaattagccaggcatggtggtgcgcacctgtagtcccagctacttgggaggctgaggcaggagaattgcttgaacccaggaggaggaggctgcagtgagctgagattgtgccactgcactccagcctgggcgacagagtgagactctgtctcaaaaaaaagaatcatctgtttccaattatttttaaatgtgcttactagaaaagataaaatcacacatggtttacattttatttctattaagacagcaccgttaagaacatagagctttgaggaattgtggtattagaaccaaatctatttaccacagtgagcttacagggagttactcgagatcttaataaaaaattataatctttggcagccttcattatgattttgtgttcttattattccagtacctctagattacatatgggaaaagctaaagagccacagtggtgagatggttgctcactctagcaggtaatttcagtttgaaaggataaaatatatgaatcatagttcacattaaccaaagtacagtgatgaaataacttagactctgaccattccatttttttcttaaagattgccctaaatctatagatgctaatacagtatttgccacaggtataaaacttgtagttactgtcattcaattaagattcttatctgtacagatatacaaatcagaaacttttaaaataaattgaactaatggaattttggctccaatatttagtcactacaatggaaatattaaagcaaggaacatgaagtcattgtagggttttaaaatggctactgactgacatgaattcagagtttcaaacagtctaaattctaaaaacttaactttacacgcttttcctcctaaataaccactctaataattcatacattcatatcttcaggtaaagaaaactgaattttaaacaattgaggctgggtgcagtggctcatgcctgtaatcgaatataaggacttgagtataaaatttgaaaactacatggggaaatgtctttatcatgcatctcttgatagtctactgaaaactattaagtaaacctgcggtctgtaaacaaaaaaacccatagtgatacttaccttgtgtaatgtaaacaattttttaagctctttaaagtacatctagatttactggtaatgtatagaagtcaattttatccccaagcatttctacttcctaaaccattagcaagagtctcaaaacaacttcactaaactattggacctccagtgttaacttgccaacataaaaatctgaaaaactttgtaatcactatcaaaaatacaaaagagagaataaattcccaggtaaaaggctttacaaattttggaactattatgcttttgtttactaaacactgatccttttagtaattctgcagtattgcctcagactcccacaaagtttcaaaatagctcatctattagattcctgtaacatttatttgggataaacgtggttttgttgccgttgttcataatagaataaaatatttagctttgatggttcagatgtaatacaaagaaataactaagtttgggcctgagataaatgtggtaaagcaagaatgcagagatgctgtaatgatgagtgagttttatagcattactgaggacctgaaaacttgctgccaaggacactttgaaggttttgttggctggaagaagtgtctctggaatcccactcctagctcttcttgaatatttgaaaagaattagataagggccatggggacccaggtcaccccacctcttcttttcagtttggctacaacattggagtcatcagtgctcctgagacagtcatacaggactttctcagttacactttgaaagagaggtcagaagactctccctctgaggttttgctcatgtccccctggcccttgtctgtggccatcttccccaatggtgatatgattggctcctttctgttgcactctttgtcaaccactttggcaggtgcagttcaatgcttatcataatttgttggctattactggttgccttatgggattctgcagacaagctgagttggttgaaatgctgatcctgggccactagattactggcttgtaatgcggactctgcacaagttttgtgcccatgtacattggagagatctcgcctactcccctttggggtacctttagtgctctcaaccagctggacgtcgttggtattctggagatccagatctttggtctggagttcatcttggggtctgaagagctatgcccagtgatactgggctttaccatccttccagctgtcctataaagtgtagcccttccattttgccctggaagtcgtaagtttttgctcattaacagaaaggaagagtactaatgagatccttcagcaattgtaggggactcaggatgtgtcccaggacatctaggagataagagtgctaggatgatacaagcaaagcaagtcactacactggcgctctttagagtacccagctaccaacaacccactgtcatttccatcatgctccagctctctcagtagctctctggaatcaatgttgtcttctattactcaatgagaatcttcaaggatgcaggtgttgagaagccaatctatagattagtgcaggagtggttaatattatcttcttgactgtagtctctctgtttgtggttgaaagggcaggaaggactttacatatgataggtcttgaggcatggcgttttgttctgtcctcatgattgtttctttgttattaaaggatgagtatggtgggatgagctttgtctgtagtggggctatcttggtctttgtggccttctctgaagttggaccagactccgttccctggaatactgtggccacactcttcagtttgcaatagcagtggctggttgctccaactggacctccaactttctagttggattgctcttcctgaacaattattatctagtttaagtgtgttgttgctttagggtcatggcatgcttatgtatttctgttaccatctgaccatggtactatgccaagttctcttaggggacctgaatctttccagtagaccacatttgagagagtatgagtcaactgggcatagttcccaacaacccaaaatacatacgtacttcactgaagcagatctcatgattccattgacttcatttctaaaattggactttgagcagccaatttctaaggattaaaaagaaactttaatgcattgtagacctctgtacacagaaaaatctttgtaacttttgggcttaattttcattcttaaaaaatctggtaactttttcaaatgcaaccactgtcagtttgctgtgaggctaggcaaacaacacaaggtatagaatttcccatcaccaccaccctgaccccgcgagaagattgccttttaattagagacttgtagaactagtgccttttaagttctacactcatcttttccaaagactattagtaaacttgccatgtaatttgacatggcagttccttgctcagctactctaaataaagttggaaattaggtggtctcttagtttgggtaaagtcagtactattgccagtaatatacatggtaattgaaagcccttaaagtggttcagattatttgccaaatattagactctataaaaatttctgaggttttttttcttttacctttgagtgtacatgtgattgctataatgtaaataccagtcccttaaagactgtttctataagcagaatgatgcagcacaaagtggaaaggttttcctcttattccagcagtattcttgccttcaaagagtagtccatcttgccttgatttttaaggttgttttcttggatggaaagcttaactggatagtaatttccatatgttctttataaccactctgtatattataagcaaagttttttcatattgtatctttttctgttgagcactttatgcattttagtctattgcatttgagaatgtagtttagaaattcactgtttaaagccatgtgaaaactgatagaggataatgaaaatgagtgtacattattttgaatttaacttaactgttttgtggtgggtgtgaacaaaacattagaaatatattatctttttgtgataatactctctgacctcacttaaagtgatctgccatgaggtatccatgatcaagtttatgtttattctaatacctaaggaattcagccaactttgtttctatcatcagataatctcagaaaatagtgtgttttatctatattactgcctcttttcaatatttaagagaataattgtcttctggtttctactgagcctagtaataatcactaaagacctaaaaaaggaattccttctgttaagagtatttggatagcccattcacgataatggtggtgtgaaaatcaatcatcccagcttttctgacatatctaaattttgaataattaatttccacttccaaaaaattcaaatgttttctcaaagcagtcactacttatttgcattattcctgcatattcagtgaatgtgaggtcatatttggtattgtattagaagtagtgttggtcactggtcttgcctctttgaacattatttttatttgtaaaatgagggagttggtttgttatgatgggaaatgagtcagttttcagggtcctgagaaaattgcttcattcatggctgtgtttgagataactaaagtaaattttttttcaggtatttggtgtcatgttttggagttaatatttagtgcttatataattttaagttattacataatttttattggtatatatttgataggtactaggtattggattctcaccaaaccagtagaatggtattctctcttaatatgtgattgcctgtaatggccaggtagatataccttaaagtaatatgaaaggttttatatgtatattaaaatgtttgtacttttaaatctgtaaaggttatctggaatttttactgtgttaacttcagaattatatgggcattatgactttttcattgtacaaaaaattattcataaatgttagaatacagatgttccttgacttacaatagggttatgttccagtagacccattgtaaattgaaaataccgtaagttgaaaatacatttaatacgcctaacctactgaacatcccagcttagcctagcctatcttaaatgtgttctgaacacttaacgttggcctttagctgggcaaaatcatctaatacaaaacctattttataatgaagtgtttaatatctcaaataagagtattgtaccacatatcgttatcccaggataatatcagagtacaaaatttgaagtacagtttttaactgaatgtgtattgcttttgccccattataaagttgaaaaaccataagtcaaaccattgttaagtcggactgtttgtgttacatatatttgggattttttagtggccctttttaaaaagctgtttcttatttctgatcattgtgagtggggatagatgtgggaagaaccatgtctctactaaaaatacaaaaaatagccaggcttgttggcacacacctatagtcccagctactcgggagaccgaggcaggagaatcacttgaaccgggaggcagagggcagatcatgccactgtattccagcctgggcaacagagtaagactctgtctcaaaaatgaatgaatgaatgaatgaacgaatgaatgtactatgagctgatactgggatttcaggtaccgcagtttgtgctgaatgatatgtttggggtaaatcagtttttttcttatagaatttcggcgtttttgctgcaactgccactaattttgcatttaaaagaacaaaagaggaatgtatttttcaaaggagtgaatgaggttaaaatcaagattttgaatggtataaatatgcaactaattcagttgtaggatattattaaattttttattgctaaatatgtttctttcatacgttgcagtgcttacagttccaacagctttccaagaaaacatttccatatttgtgttatttgtaaagtatacataaataatgtaaaataatttgggattatttcaactttacattgtatgtctgaatttcatcgatgttgtacctggctcagtcaatagttgtcacaggtattaagccattttggaatttgccacttttttctgggtaacctgttttagtttagtttacagcatttagaaacagaaggtaactttatagaagtaacaccaatatcctagtctgcttgccccgaatataactaatagtattaggatgtaagcaatatataagaaggcgtaattatttatacacgggggttattttantnaananagnaaaatggtttttcactaaatagaaggggttacttaagacagttttgcaagggtccgaaagtt

SEQ ID NO: 344999 - DNA, 10420 bp, Homo sapiens
ggcggcggctccggggaccggggccttttgtttggagcggctgcgggggggccccggagcggcgaggccggcggccttccccagcttgctcggtcccggccacccctcgcgggggtggggggccgccccctgggccgggcatctcctcaggcgccgccgccccgccctaggccgcctctgctctcagtgccccggatcggaggccgtccatcgcccctcgggccgacgccatgaagatcaaagatgccaagaaaccctctttcccatggtttggcatggacattgggggaactctagtaaagctctcgtactttgaacctattgatatcacagcagaggaagagcaagaagaagttgagagtttaaaaagtattcggaaatatttgacttctaacgtggcatatggatccaccggcattcgggatgtacaccttgaactgaaagatttaacactttttggccgaagagggaacttgcactttatcaggtttccaacccaggacctgcctacttttatccaaatgggaagagataaaaacttctcaacattgcagacggtgctatgtgctacaggaggtggtgcttacaagtttgaaaaagattttcgcacaattggaaacctccacctgcacaaactggatgaacttgactgccttgtaaagggcttgctgtatatagactctgtcagtttcaatggacaagccgagtgctattattttgctaatgcctcagaacctgagcgatgccaaaagatgccttttaacctggatgatccctatccactgcttgtagtgaacattggctcaggagtcagtattttagcagtccattccaaagacaactataaacgagtgactgggacaagccttggagggggtacctttctgggtttatgcagtttattgactggctgtgaaagttttgaagaggctcttgaaatggcatccaaaggtgatagcacacaagctgacaagctggtccgtgatatttatggaggagattatgaaagatttggtttgccaggttgggctgtagcatctagttttgggaatatgatttataaggagaagcgagaatctgttagtaaagaagatctggcaagagctactttagttactatcaccaataacattggttctgtggcacgaatgtgtgctgttaatgagaaaataaacagagttgtctttgttggaaactttttacgtgtcaataccctctcaatgaaacttttggcatatgcactggattactggtcaaaaggtcaactaaaagcattgtttctagaacatgagggttactttggagcagttggtgcacttcttgggctgccaaatttcagctaaagcatcaggtctctctctctgctaataaatgtcatccaagaggaactaaaaccagaggcattattactgcattgtttgtcactgggaaccaaaggataaaagagtagcataagctgctgaatgttgccatattaaaggagagaacttggtaacgtgaagtatttctcattgaaatgctttcccttttgtatatagccagtgttaaatccttaaatgcaatacagcctctgattattgagcttcctcttaaaaagatttttttattttatgtagccaacattgcagtactgtatgctcaaacacaaatcttaaagtatcggaactgtttagcttatgaaaataatcgactctgaatatttgttacaagtctgttttatgtgttttgattactagtgagcagaaaataacataccctgtattcaaaattactgaaatggcaatcaaagatgatcatttttatgtgattttagaaatgttaaggcaatactactaattattgtaggtttttttaacgtatcacccaaagcatgtatgtgatctttccccattagtatctttttctcaaatgccataattaactgaaatactattattaaattttcatgagaattctaaaatgaatcctgggaaatgcacgtttggtgatgttgcactttctgtattttacaggaattagtcaatacatgttgaaatgtttaacattttaagattggaggcttaattactgggagtctgtctaatgaagtcctgggactattgtaatggaatatgatttgagttcactgtgctctttttgtttgtttgttttggtcatatatacattcagaacttttattttaaaacaaccacaataacattaataatagaaaattcatctgtaaatattcacagtctagtcactgaaaaatgggaaaacctctaccatgccttattattaccctttgctgtttgaggagccagaaatagaggtgcagttagaggacggtcactttttccaacaaaacccactccatagccatgtggatttttatccaaaggctcaacaaccagagggaatggtgagacctgataactaaaatactgttattggcaagggtttgaaatgtgtaagaacctaggagggaaaggaagattgagcaacataggaaaaggggaagagaggctgagtgtcaccaaggtccaaactccatttataaaaatactgcaaaaccaggagttgatggtagaagtgcatatgatccatggcaggagtaaatctctccacctcctctaactctctgaaaactctagagttggagcaagtcttccatttgcttcttatccccttaaaagaatgccttccacttcccaacagcccccatcaagggaccccaagaggccaccatgctcttatctcgcactttctttcctattccccttgcctgaatctggagtggggttgagccctctgccttcaaccttaagatttaggaagttctttccccaactgtctaacttggaaaggtagatgagtctgaattttgaagtaacgaatgcaaattccactcagcagaggcaatgttatttatgtacatagggatagtggaatgagttttaatagattctgtccaaaaggggtttgttcctcttatttcctctatgtaggaagttgtgtcttaggcaactttatcagtatcaatggaaaaatgataggcactacaatgaaatggcaggatgccaatatgagatatttcaggaataataagaaatacagtttgtttgtataaaataaactatctcaagaaagttttcaacgacagtgatagtgttcatttgtaagagagagttctagaacttcgatgtccagtgcagtagccactacccatatgtagctgttgagcatttgaaatatggttagtccaaattgagatgtgctctaaaggacaataaaaggttaaatatctcctaattttttgtattgattacatgttgaaatgttaacattggaaatattgggttaaagaaaaatacacaattaaaatgaatcttggccaggcgcagtggctcacgcctctaatcccagcactttgagaggccagggtgggcaggtcacctgaggtcaggagttcgagaccagcctggccagtgtggcaaaaccctgcctactaaaaatacaaaaattagccaggcatggtggtgcgcacctgtagtcccagctacttgggaggctgaggcaggagaattgcttgaacccaggaggaggaggctgcagtgagctgagattgtgccactgcactccagcctgggcgacagagtgagactctgtctcaaaaaaaagaatcatctgtttccaattatttttaaatgtgcttactagaaaagataaaatcacacatggtttacattttatttctattaagacagcaccgttaagaacatagagctttgaggaattgtggtattagaaccaaatctatttaccacagtgagcttacagggagttactcgagatcttaataaaaaattataatctttggcagccttcattatgattttgtgttcttattattccagtacctctagattacatatgggaaaagctaaagagccacagtggtgagatggttgctcactctagcaggtaatttcagtttgaaaggataaaatatatgaatcatagttcacattaaccaaagtacagtgatgaaataacttagactctgaccattccatttttttcttaaagattgccctaaatctatagatgctaatacagtatttgccacaggtataaaacttgtagttactgtcattcaattaagattcttatctgtacagatatacaaatcagaaacttttaaaataaattgaactaatggaattttggctccaatatttagtcactacaatggaaatattaaagcaaggaacatgaagtcattgtagggttttaaaatggctactgactgacatgaattcagagtttcaaacagtctaaattctaaaaacttaactttacacgcttttcctcctaaataaccactctaataattcatacattcatatcttcaggtaaagaaaactgaattttaaacaattgaggctgggtgcagtggctcatgcctgtaatcgaatataaggacttgagtataaaatttgaaaactacatggggaaatgtctttatcatgcatctcttgatagtctactgaaaactattaagtaaacctgcggtctgtaaacaaaaaaacccatagtgatacttaccttgtgtaatgtaaacaattttttaagctctttaaagtacatctagatttactggtaatgtatagaagtcaattttatccccaagcatttctacttcctaaaccattagcaagagtctcaaaacaacttcactaaactattggacctccagtgttaacttgccaacataaaaatctgaaaaactttgtaatcactatcaaaaatacaaaagagagaataaattcccaggtaaaaggctttacaaattttggaactattatgcttttgtttactaaacactgatccttttagtaattctgcagtattgcctcagactcccacaaagtttcaaaatagctcatctattagattcctgtaacatttatttgggataaacgtggttttgttgccgttgttcataatagaataaaatatttagctttgatggttcagatgtaatacaaagaaataactaagtttgggcctgagataaatgtggtaaagcaagaatgcagagatgctgtaatgatgagtgagttttatagcattactgaggacctgaaaacttgctgccaaggacactttgaaggttttgttggctggaagaagtgtctctggaatcccactcctagctcttcttgaatatttgaaaagaattagataagggccatggggacccaggtcaccccacctcttcttttcagtttggctacaacattggagtcatcagtgctcctgagacagtcatacaggactttctcagttacactttgaaagagaggtcagaagactctccctctgaggttttgctcatgtccccctggcccttgtctgtggccatcttccccaatggtgatatgattggctcctttctgttgcactctttgtcaaccactttggcaggtgcagttcaatgcttatcataatttgttggctattactggttgccttatgggattctgcagacaagctgagttggttgaaatgctgatcctgggccactagattactggcttgtaatgcggactctgcacaagttttgtgcccatgtacattggagagatctcgcctactcccctttggggtacctttagtgctctcaaccagctggacgtcgttggtattctggagatccagatctttggtctggagttcatcttggggtctgaagagctatgcccagtgatactgggctttaccatccttccagctgtcctataaagtgtagcccttccattttgccctggaagtcgtaagtttttgctcattaacagaaaggaagagtactaatgagatccttcagcaattgtaggggactcaggatgtgtcccaggacatctaggagataagagtgctaggatgatacaagcaaagcaagtcactacactggcgctctttagagtacccagctaccaacaacccactgtcatttccatcatgctccagctctctcagtagctctctggaatcaatgttgtcttctattactcaatgagaatcttcaaggatgcaggtgttgagaagccaatctatagattagtgcaggagtggttaatattatcttcttgactgtagtctctctgtttgtggttgaaagggcaggaaggactttacatatgataggtcttgaggcatggcgttttgttctgtcctcatgattgtttctttgttattaaaggatgagtatggtgggatgagctttgtctgtagtggggctatcttggtctttgtggccttctctgaagttggaccagactccgttccctggaatactgtggccacactcttcagtttgcaatagcagtggctggttgctccaactggacctccaactttctagttggattgctcttcctgaacaattattatctagtttaagtgtgttgttgctttagggtcatggcatgcttatgtatttctgttaccatctgaccatggtactatgccaagttctcttaggggacctgaatctttccagtagaccacatttgagagagtatgagtcaactgggcatagttcccaacaacccaaaatacatacgtacttcactgaagcagatctcatgattccattgacttcatttctaaaattggactttgagcagccaatttctaaggattaaaaagaaactttaatgcattgtagacctctgtacacagaaaaatctttgtaacttttgggcttaattttcattcttaaaaaatctggtaactttttcaaatgcaaccactgtcagtttgctgtgaggctaggcaaacaacacaaggtatagaatttcccatcaccaccaccctgaccccgcgagaagattgccttttaattagagacttgtagaactagtgccttttaagttctacactcatcttttccaaagactattagtaaacttgccatgtaatttgacatggcagttccttgctcagctactctaaataaagttggaaattaggtggtctcttagtttgggtaaagtcagtactattgccagtaatatacatggtaattgaaagcccttaaagtggttcagattatttgccaaatattagactctataaaaatttctgaggttttttttcttttacctttgagtgtacatgtgattgctataatgtaaataccagtcccttaaagactgtttctataagcagaatgatgcagcacaaagtggaaaggttttcctcttattccagcagtattcttgccttcaaagagtagtccatcttgccttgatttttaaggttgttttcttggatggaaagcttaactggatagtaatttccatatgttctttataaccactctgtatattataagcaaagttttttcatattgtatctttttctgttgagcactttatgcattttagtctattgcatttgagaatgtagtttagaaattcactgtttaaagccatgtgaaaactgatagaggataatgaaaatgagtgtacattattttgaatttaacttaactgttttgtggtgggtgtgaacaaaacattagaaatatattatctttttgtgataatactctctgacctcacttaaagtgatctgccatgaggtatccatgatcaagtttatgtttattctaatacctaaggaattcagccaactttgtttctatcatcagataatctcagaaaatagtgtgttttatctatattactgcctcttttcaatatttaagagaataattgtcttctggtttctactgagcctagtaataatcactaaagacctaaaaaaggaattccttctgttaagagtatttggatagcccattcacgataatggtggtgtgaaaatcaatcatcccagcttttctgacatatctaaattttgaataattaatttccacttccaaaaaattcaaatgttttctcaaagcagtcactacttatttgcattattcctgcatattcagtgaatgtgaggtcatatttggtattgtattagaagtagtgttggtcactggtcttgcctctttgaacattatttttatttgtaaaatgagggagttggtttgttatgatgggaaatgagtcagttttcagggtcctgagaaaattgcttcattcatggctgtgtttgagataactaaagtaaattttttttcaggtatttggtgtcatgttttggagttaatatttagtgcttatataattttaagttattacataatttttattggtatatatttgataggtactaggtattggattctcaccaaaccagtagaatggtattctctcttaatatgtgattgcctgtaatggccaggtagatataccttaaagtaatatgaaaggttttatatgtatattaaaatgtttgtacttttaaatctgtaaaggttatctggaatttttactgtgttaacttcagaattatatgggcattatgactttttcattgtacaaaaaattattcataaatgttagaatacagatgttccttgacttacaatagggttatgttccagtagacccattgtaaattgaaaataccgtaagttgaaaatacatttaatacgcctaacctactgaacatcccagcttagcctagcctatcttaaatgtgttctgaacacttaacgttggcctttagctgggcaaaatcatctaatacaaaacctattttataatgaagtgtttaatatctcaaataagagtattgtaccacatatcgttatcccaggataatatcagagtacaaaatttgaagtacagtttttaactgaatgtgtattgcttttgccccattataaagttgaaaaaccataagtcaaaccattgttaagtcggactgtttgtgttacatatatttgggattttttagtggccctttttaaaaagctgtttcttatttctgatcattgtgagtggggatagatgtgggaagaaccatgtctctactaaaaatacaaaaaatagccaggcttgttggcacacacctatagtcccagctactcgggagaccgaggcaggagaatcacttgaaccgggaggcagagggcagatcatgccactgtattccagcctgggcaacagagtaagactctgtctcaaaaatgaatgaatgaatgaatgaacgaatgaatgtactatgagctgatactgggatttcaggtaccgcagtttgtgctgaatgatatgtttggggtaaatcagtttttttcttatagaatttcggcgtttttgctgcaactgccactaattttgcatttaaaagaacaaaagaggaatgtatttttcaaaggagtgaatgaggttaaaatcaagattttgaatggtataaatatgcaactaattcagttgtaggatattattaaattttttattgctaaatatgtttctttcatacgttgcagtgcttacagttccaacagctttccaagaaaacatttccatatttgtgttatttgtaaagtatacataaataatgtaaaataatttgggattatttcaactttacattgtatgtctgaatttcatcgatgttgtacctggctcagtcaatagttgtcacaggtattaagccattttggaatttgccacttttttctgggtaacctgttttagtttagtttacagcatttagaaacagaaggtaactttatagaagtaacaccaatatcctagtctgcttgccccgaatataactaatagtattaggatgtaagcaatattaagatggtttttattattttttatacactgtgtgcttttactttttatttaaactacagcaaaaaactgattttttaactaaaattgaatggcgtttatcttaatgaccagttattgaccaaagtgtactcagaagatgttattatgtcccaatctaaggaatcctttaatttggggattaattttacttacacatgccatttcagtttcagttgcctcattctattacatcattcttgtcaagtctaagctttatcatgtctgaattcttttaacactgaatctgtgatgtaaaaatgtatgatgtgccataaattttattcataataaactaagttatagcctattgtaatctgtaaaacatttcttgtaaattacctaatttattttttcatttatgtacagtatcttatgtaaatttgaaaaatgtttgccatggcgcattctgtaaacattcccgtattcttttccttaatgcttatttgcatgaaggtaacttgggttttgcttgtttgtattggataaccattaagccaacttcagtttctctgcctttttttctgtagtttaaccatttctaattttgttcatattctaaatagatgttagaatcatactttttattttctactttctaaataaattatctaagttgtttacta

SEQ ID NO: 345000 - DNA, 10313 bp, Homo sapiens
  misc_feature (196)..(196): n is a, c, g, or t
ggcggcggctccggggaccggggccttttgtttggagcggctgcgggggggccccggagcggcgaggccggcggccttccccagcttgctcggtcccggccacccctcgcgggggtggggggccgccccctgggccgggcatctcctcaggcgccgccgccccgccctaggccggccccgcccggcctgaggggangaaccggccgggcctcgccgcgcggcccagccacctccggagtcgccgcctctgctctcagtgccccggatcggaggccgtccatcgcccctcgggccgacgccatgaagatcaaagatgccaagaaaccctctttcccatggtttggcatggacattgggggaactctagtaaagctctcgtactttgaacctattgatatcacagcagaggaagagcaagaagaagttgagagtttaaaaagtattcggaaatatttgacttctaacgtggcatatggatccaccggcattcgggatgtacaccttgaactgaaagatttaacactttttggccgaagagggaacttgcactttatcaggtttccaacccaggacctgcctacttttatccaaatgggaagagataaaaacttctcaacattgcagacggtgctatgtgctacaggaggtggtgcttacaagtttgaaaaagattttcgcacaattggaaacctccacctgcacaaactggatgaacttgactgccttgtaaagggcttgctgtatatagactctgtcagtttcaatggacaagccgagtgctattattttgctaatgcctcagaacctgagcgatgccaaaagatgccttttaacctggatgatccctatccactgcttgtagtgaacattggctcaggagtcagtattttagcagtccattccaaagacaactataaacgagtgactgggacaagttttgggaatatgatttataaggagaagcgagaatctgttagtaaagaagatctggcaagagctactttagttactatcaccaataacattggttctgtggcacgaatgtgtgctgttaatgagaaaataaacagagttgtctttgttggaaactttttacgtgtcaataccctctcaatgaaacttttggcatatgcactggattactggtcaaaaggtcaactaaaagcattgtttctagaacatgagggttactttggagcagttggtgcacttcttgggctgccaaatttcagctaaagcatcaggtctctctctctgctaataaatgtcatccaagaggaactaaaaccagaggcattattactgcattgtttgtcactgggaaccaaaggataaaagagtagcataagctgctgaatgttgccatattaaaggagagaacttggtaacgtgaagtatttctcattgaaatgctttcccttttgtatatagccagtgttaaatccttaaatgcaatacagcctctgattattgagcttcctcttaaaaagatttttttattttatgtagccaacattgcagtactgtatgctcaaacacaaatcttaaagtatcggaactgtttagcttatgaaaataatcgactctgaatatttgttacaagtctgttttatgtgttttgattactagtgagcagaaaataacataccctgtattcaaaattactgaaatggcaatcaaagatgatcatttttatgtgattttagaaatgttaaggcaatactactaattattgtaggtttttttaacgtatcacccaaagcatgtatgtgatctttccccattagtatctttttctcaaatgccataattaactgaaatactattattaaattttcatgagaattctaaaatgaatcctgggaaatgcacgtttggtgatgttgcactttctgtattttacaggaattagtcaatacatgttgaaatgtttaacattttaagattggaggcttaattactgggagtctgtctaatgaagtcctgggactattgtaatggaatatgatttgagttcactgtgctctttttgtttgtttgttttggtcatatatacattcagaacttttattttaaaacaaccacaataacattaataatagaaaattcatctgtaaatattcacagtctagtcactgaaaaatgggaaaacctctaccatgccttattattaccctttgctgtttgaggagccagaaatagaggtgcagttagaggacggtcactttttccaacaaaacccactccatagccatgtggatttttatccaaaggctcaacaaccagagggaatggtgagacctgataactaaaatactgttattggcaagggtttgaaatgtgtaagaacctaggagggaaaggaagattgagcaacataggaaaaggggaagagaggctgagtgtcaccaaggtccaaactccatttataaaaatactgcaaaaccaggagttgatggtagaagtgcatatgatccatggcaggagtaaatctctccacctcctctaactctctgaaaactctagagttggagcaagtcttccatttgcttcttatccccttaaaagaatgccttccacttcccaacagcccccatcaagggaccccaagaggccaccatgctcttatctcgcactttctttcctattccccttgcctgaatctggagtggggttgagccctctgccttcaaccttaagatttaggaagttctttccccaactgtctaacttggaaaggtagatgagtctgaattttgaagtaacgaatgcaaattccactcagcagaggcaatgttatttatgtacatagggatagtggaatgagttttaatagattctgtccaaaaggggtttgttcctcttatttcctctatgtaggaagttgtgtcttaggcaactttatcagtatcaatggaaaaatgataggcactacaatgaaatggcaggatgccaatatgagatatttcaggaataataagaaatacagtttgtttgtataaaataaactatctcaagaaagttttcaacgacagtgatagtgttcatttgtaagagagagttctagaacttcgatgtccagtgcagtagccactacccatatgtagctgttgagcatttgaaatatggttagtccaaattgagatgtgctctaaaggacaataaaaggttaaatatctcctaattttttgtattgattacatgttgaaatgttaacattggaaatattgggttaaagaaaaatacacaattaaaatgaatcttggccaggcgcagtggctcacgcctctaatcccagcactttgagaggccagggtgggcaggtcacctgaggtcaggagttcgagaccagcctggccagtgtggcaaaaccctgcctactaaaaatacaaaaattagccaggcatggtggtgcgcacctgtagtcccagctacttgggaggctgaggcaggagaattgcttgaacccaggaggaggaggctgcagtgagctgagattgtgccactgcactccagcctgggcgacagagtgagactctgtctcaaaaaaaagaatcatctgtttccaattatttttaaatgtgcttactagaaaagataaaatcacacatggtttacattttatttctattaagacagcaccgttaagaacatagagctttgaggaattgtggtattagaaccaaatctatttaccacagtgagcttacagggagttactcgagatcttaataaaaaattataatctttggcagccttcattatgattttgtgttcttattattccagtacctctagattacatatgggaaaagctaaagagccacagtggtgagatggttgctcactctagcaggtaatttcagtttgaaaggataaaatatatgaatcatagttcacattaaccaaagtacagtgatgaaataacttagactctgaccattccatttttttcttaaagattgccctaaatctatagatgctaatacagtatttgccacaggtataaaacttgtagttactgtcattcaattaagattcttatctgtacagatatacaaatcagaaacttttaaaataaattgaactaatggaattttggctccaatatttagtcactacaatggaaatattaaagcaaggaacatgaagtcattgtagggttttaaaatggctactgactgacatgaattcagagtttcaaacagtctaaattctaaaaacttaactttacacgcttttcctcctaaataaccactctaataattcatacattcatatcttcaggtaaagaaaactgaattttaaacaattgaggctgggtgcagtggctcatgcctgtaatcgaatataaggacttgagtataaaatttgaaaactacatggggaaatgtctttatcatgcatctcttgatagtctactgaaaactattaagtaaacctgcggtctgtaaacaaaaaaacccatagtgatacttaccttgtgtaatgtaaacaattttttaagctctttaaagtacatctagatttactggtaatgtatagaagtcaattttatccccaagcatttctacttcctaaaccattagcaagagtctcaaaacaacttcactaaactattggacctccagtgttaacttgccaacataaaaatctgaaaaactttgtaatcactatcaaaaatacaaaagagagaataaattcccaggtaaaaggctttacaaattttggaactattatgcttttgtttactaaacactgatccttttagtaattctgcagtattgcctcagactcccacaaagtttcaaaatagctcatctattagattcctgtaacatttatttgggataaacgtggttttgttgccgttgttcataatagaataaaatatttagctttgatggttcagatgtaatacaaagaaataactaagtttgggcctgagataaatgtggtaaagcaagaatgcagagatgctgtaatgatgagtgagttttatagcattactgaggacctgaaaacttgctgccaaggacactttgaaggttttgttggctggaagaagtgtctctggaatcccactcctagctcttcttgaatatttgaaaagaattagataagggccatggggacccaggtcaccccacctcttcttttcagtttggctacaacattggagtcatcagtgctcctgagacagtcatacaggactttctcagttacactttgaaagagaggtcagaagactctccctctgaggttttgctcatgtccccctggcccttgtctgtggccatcttccccaatggtgatatgattggctcctttctgttgcactctttgtcaaccactttggcaggtgcagttcaatgcttatcataatttgttggctattactggttgccttatgggattctgcagacaagctgagttggttgaaatgctgatcctgggccactagattactggcttgtaatgcggactctgcacaagttttgtgcccatgtacattggagagatctcgcctactcccctttggggtacctttagtgctctcaaccagctggacgtcgttggtattctggagatccagatctttggtctggagttcatcttggggtctgaagagctatgcccagtgatactgggctttaccatccttccagctgtcctataaagtgtagcccttccattttgccctggaagtcgtaagtttttgctcattaacagaaaggaagagtactaatgagatccttcagcaattgtaggggactcaggatgtgtcccaggacatctaggagataagagtgctaggatgatacaagcaaagcaagtcactacactggcgctctttagagtacccagctaccaacaacccactgtcatttccatcatgctccagctctctcagtagctctctggaatcaatgttgtcttctattactcaatgagaatcttcaaggatgcaggtgttgagaagccaatctatagattagtgcaggagtggttaatattatcttcttgactgtagtctctctgtttgtggttgaaagggcaggaaggactttacatatgataggtcttgaggcatggcgttttgttctgtcctcatgattgtttctttgttattaaaggatgagtatggtgggatgagctttgtctgtagtggggctatcttggtctttgtggccttctctgaagttggaccagactccgttccctggaatactgtggccacactcttcagtttgcaatagcagtggctggttgctccaactggacctccaactttctagttggattgctcttcctgaacaattattatctagtttaagtgtgttgttgctttagggtcatggcatgcttatgtatttctgttaccatctgaccatggtactatgccaagttctcttaggggacctgaatctttccagtagaccacatttgagagagtatgagtcaactgggcatagttcccaacaacccaaaatacatacgtacttcactgaagcagatctcatgattccattgacttcatttctaaaattggactttgagcagccaatttctaaggattaaaaagaaactttaatgcattgtagacctctgtacacagaaaaatctttgtaacttttgggcttaattttcattcttaaaaaatctggtaactttttcaaatgcaaccactgtcagtttgctgtgaggctaggcaaacaacacaaggtatagaatttcccatcaccaccaccctgaccccgcgagaagattgccttttaattagagacttgtagaactagtgccttttaagttctacactcatcttttccaaagactattagtaaacttgccatgtaatttgacatggcagttccttgctcagctactctaaataaagttggaaattaggtggtctcttagtttgggtaaagtcagtactattgccagtaatatacatggtaattgaaagcccttaaagtggttcagattatttgccaaatattagactctataaaaatttctgaggttttttttcttttacctttgagtgtacatgtgattgctataatgtaaataccagtcccttaaagactgtttctataagcagaatgatgcagcacaaagtggaaaggttttcctcttattccagcagtattcttgccttcaaagagtagtccatcttgccttgatttttaaggttgttttcttggatggaaagcttaactggatagtaatttccatatgttctttataaccactctgtatattataagcaaagttttttcatattgtatctttttctgttgagcactttatgcattttagtctattgcatttgagaatgtagtttagaaattcactgtttaaagccatgtgaaaactgatagaggataatgaaaatgagtgtacattattttgaatttaacttaactgttttgtggtgggtgtgaacaaaacattagaaatatattatctttttgtgataatactctctgacctcacttaaagtgatctgccatgaggtatccatgatcaagtttatgtttattctaatacctaaggaattcagccaactttgtttctatcatcagataatctcagaaaatagtgtgttttatctatattactgcctcttttcaatatttaagagaataattgtcttctggtttctactgagcctagtaataatcactaaagacctaaaaaaggaattccttctgttaagagtatttggatagcccattcacgataatggtggtgtgaaaatcaatcatcccagcttttctgacatatctaaattttgaataattaatttccacttccaaaaaattcaaatgttttctcaaagcagtcactacttatttgcattattcctgcatattcagtgaatgtgaggtcatatttggtattgtattagaagtagtgttggtcactggtcttgcctctttgaacattatttttatttgtaaaatgagggagttggtttgttatgatgggaaatgagtcagttttcagggtcctgagaaaattgcttcattcatggctgtgtttgagataactaaagtaaattttttttcaggtatttggtgtcatgttttggagttaatatttagtgcttatataattttaagttattacataatttttattggtatatatttgataggtactaggtattggattctcaccaaaccagtagaatggtattctctcttaatatgtgattgcctgtaatggccaggtagatataccttaaagtaatatgaaaggttttatatgtatattaaaatgtttgtacttttaaatctgtaaaggttatctggaatttttactgtgttaacttcagaattatatgggcattatgactttttcattgtacaaaaaattattcataaatgttagaatacagatgttccttgacttacaatagggttatgttccagtagacccattgtaaattgaaaataccgtaagttgaaaatacatttaatacgcctaacctactgaacatcccagcttagcctagcctatcttaaatgtgttctgaacacttaacgttggcctttagctgggcaaaatcatctaatacaaaacctattttataatgaagtgtttaatatctcaaataagagtattgtaccacatatcgttatcccaggataatatcagagtacaaaatttgaagtacagtttttaactgaatgtgtattgcttttgccccattataaagttgaaaaaccataagtcaaaccattgttaagtcggactgtttgtgttacatatatttgggattttttagtggccctttttaaaaagctgtttcttatttctgatcattgtgagtggggatagatgtgggaagaaccatgtctctactaaaaatacaaaaaatagccaggcttgttggcacacacctatagtcccagctactcgggagaccgaggcaggagaatcacttgaaccgggaggcagagggcagatcatgccactgtattccagcctgggcaacagagtaagactctgtctcaaaaatgaatgaatgaatgaatgaacgaatgaatgtactatgagctgatactgggatttcaggtaccgcagtttgtgctgaatgatatgtttggggtaaatcagtttttttcttatagaatttcggcgtttttgctgcaactgccactaattttgcatttaaaagaacaaaagaggaatgtatttttcaaaggagtgaatgaggttaaaatcaagattttgaatggtataaatatgcaactaattcagttgtaggatattattaaattttttattgctaaatatgtttctttcatacgttgcagtgcttacagttccaacagctttccaagaaaacatttccatatttgtgttatttgtaaagtatacataaataatgtaaaataatttgggattatttcaactttacattgtatgtctgaatttcatcgatgttgtacctggctcagtcaatagttgtcacaggtattaagccattttggaatttgccacttttttctgggtaacctgttttagtttagtttacagcatttagaaacagaaggtaactttatagaagtaacaccaatatcctagtctgcttgccccgaatataactaatagtattaggatgtaagcaatattaagatggtttttattattttttatacactgtgtgcttttactttttatttaaactacagcaaaaaactgattttttaactaaaattgaatggcgtttatcttaatgaccagttattgaccaaagtgtactcagaagatgttattatgtcccaatctaaggaatcctttaatttggggattaattttacttacacatgccatttcagtttcagttgcctcattctattacatcattcttgtcaagtctaagctttatcatgtctgaattcttttaacactgaatctgtgatgtaaaaatgtatgatgtgccataaattttattcataataaactaagttatagcctattgtaatctgtaaaacatttcttgtaaattacctaatttattttttcatttatgtacagtatcttatgtaaatttgaaaaatgtttgccatggcgcattctgtaaacattcccgtattcttttccttaatgcttatttgcatgaaggtaacttgggttttgcttgtttgtattggataaccattaagccaacttcagtttctctgcctttttttctgtagtttaaccatttctaattttgttcatattctaaatagatgttagaatcatactttttattttctactttctaaataaattatctaagttgtttacta

SEQ ID NO: 345001 - DNA, 6387 bp, Homo sapiens
  misc_feature (196)..(196): n is a, c, g, or t
  misc_feature (6352)..(6352): n is a, c, g, or t
  misc_feature (6368)..(6368): n is a, c, g, or t
ggcggcggctccggggaccggggccttttgtttggagcggctgcgggggggccccggagcggcgaggccggcggccttccccagcttgctcggtcccggccacccctcgcgggggtggggggccgccccctgggccgggcatctcctcaggcgccgccgccccgccctaggccggccccgcccggcctgaggggangaaccggccgggcctcgccgcgcggcccagccacctccggagtcgccgcctctgctctcagtgccccggatcggaggccgtccatcgcccctcgggccgacgccatgaagatcaaagatgccaagaaaccctctttcccatggtttggcatggacattgggggaactctagtaaagctctcgtactttgaacctattgatatcacagcagaggaagagcaagaagaagttgagagtttaaaaagtattcggaaatatttgacttctaacgtggcatatggatccaccggcattcgggatgtacaccttgaactgaaagatttaacactttttggccgaagagggaacttgcactttatcaggtttccaacccaggacctgcctacttttatccaaatgggaagagataaaaacttctcaacattgcagacggtgctatgtgctacaggaggtggtgcttacaagtttgaaaaagattttcgcacaattggaaacctccacctgcacaaactggatgaacttgactgccttgtaaagggcttgctgtatatagactctgtcagtttcaatggacaagccgagtgctattattttgctaatgcctcagaacctgagcgatgccaaaagatgccttttaacctggatgatccctatccactgcttgtagtgaacattggctcaggagtcagtattttagcagtccattccaaagacaactataaacgagtgactgggacaagccttggagggggtacctttctgggtttatgcagtttattgactggctgtgaaagttttgaagaggctcttgaaatggcatccaaaggtgatagcacacaagctgacaagctggtccgtgatatttatggaggagattatgaaagatttggtttgccaggttgggctgtagcatctagttttgggaatatgatttataaggagaagcgagaatctgttagtaaagaagatctggcaagagctactttagttactatcaccaataacattggttctgtggcacgaatgtgtgctgttaatgagaaaataaacagagttgtctttgttggaaactttttacgtgtcaataccctctcaatgaaacttttggcatatgcactggattactggtcaaaaggtcaactaaaagcattgtttctagaacatgagggttactttggagcagttggtgcacttcttgggctgccaaatttcagctaaagcatcaggtctctctctctgctaataaatgtcatccaagaggaactaaaaccagaggcattattactgcattgtttgtcactgggaaccaaaggataaaagagtagcataagctgctgaatgttgccatattaaaggagagaacttggtaacgtgaagtatttctcattgaaatgctttcccttttgtatatagccagtgttaaatccttaaatgcaatacagcctctgattattgagcttcctcttaaaaagatttttttattttatgtagccaacattgcagtactgtatgctcaaacacaaatcttaaagtatcggaactgtttagcttatgaaaataatcgactctgaatatttgttacaagtctgttttatgtgttttgattactagtgagcagaaaataacataccctgtattcaaaattactgaaatggcaatcaaagatgatcatttttatgtgattttagaaatgttaaggcaatactactaattattgtaggtttttttaacgtatcacccaaagcatgtatgtgatctttccccattagtatctttttctcaaatgccataattaactgaaatactattattaaattttcatgagaattctaaaatgaatcctgggaaatgcacgtttggtgatgttgcactttctgtattttacaggaattagtcaatacatgttgaaatgtttaacattttaagattggaggcttaattactgggagtctgtctaatgaagtcctgggactattgtaatggaatatgatttgagttcactgtgctctttttgtttgtttgttttggtcatatatacattcagaacttttattttaaaacaaccacaataacattaataatagaaaattcatctgtaaatattcacagtctagtcactgaaaaatgggaaaacctctaccatgccttattattaccctttgctgtttgaggagccagaaatagaggtgcagttagaggacggtcactttttccaacaaaacccactccatagccatgtggatttttatccaaaggctcaacaaccagagggaatggtgagacctgataactaaaatactgttattggcaagggtttgaaatgtgtaagaacctaggagggaaaggaagattgagcaacataggaaaaggggaagagaggctgagtgtcaccaaggtccaaactccatttataaaaatactgcaaaaccaggagttgatggtagaagtgcatatgatccatggcaggagtaaatctctccacctcctctaactctctgaaaactctagagttggagcaagtcttccatttgcttcttatccccttaaaagaatgccttccacttcccaacagcccccatcaagggaccccaagaggccaccatgctcttatctcgcactttctttcctattccccttgcctgaatctggagtggggttgagccctctgccttcaaccttaagatttaggaagttctttccccaactgtctaacttggaaaggtagatgagtctgaattttgaagtaacgaatgcaaattccactcagcagaggcaatgttatttatgtacatagggatagtggaatgagttttaatagattctgtccaaaaggggtttgttcctcttatttcctctatgtaggaagttgtgtcttaggcaactttatcagtatcaatggaaaaatgataggcactacaatgaaatggcaggatgccaatatgagatatttcaggaataataagaaatacagtttgtttgtataaaataaactatctcaagaaagttttcaacgacagtgatagtgttcatttgtaagagagagttctagaacttcgatgtccagtgcagtagccactacccatatgtagctgttgagcatttgaaatatggttagtccaaattgagatgtgctctaaaggacaataaaaggttaaatatctcctaattttttgtattgattacatgttgaaatgttaacattggaaatattgggttaaagaaaaatacacaattaaaatgaatcttggccaggcgcagtggctcacgcctctaatcccagcactttgagaggccagggtgggcaggtcacctgaggtcaggagttcgagaccagcctggccagtgtggcaaaaccctgcctactaaaaatacaaaaattagccaggcatggtggtgcgcacctgtagtcccagctacttgggaggctgaggcaggagaattgcttgaacccaggaggaggaggctgcagtgagctgagattgtgccactgcactccagcctgggcgacagagtgagactctgtctcaaaaaaaagaatcatctgtttccaattatttttaaatgtgcttactagaaaagataaaatcacacatggtttacattttatttctattaagacagcaccgttaagaacatagagctttgaggaattgtggtattagaaccaaatctatttaccacagtgagcttacagggagttactcgagatcttaataaaaaattataatctttggcagccttcattatgattttgtgttcttattattccagtacctctagattacatatgggaaaagctaaagagccacagtggtgagatggttgctcactctagcaggtaatttcagtttgaaaggataaaatatatgaatcatagttcacattaaccaaagtacagtgatgaaataacttagactctgaccattccatttttttcttaaagattgccctaaatctatagatgctaatacagtatttgccacaggtataaaacttgtagttactgtcattcaattaagattcttatctgtacagatatacaaatcagaaacttttaaaataaattgaactaatggaattttggctccaatatttagtcactacaatggaaatattaaagcaaggaacatgaagtcattgtagggttttaaaatggctactgactgacatgaattcagagtttcaaacagtctaaattctaaaaacttaactttacacgcttttcctcctaaataaccactctaataattcatacattcatatcttcaggtaaagaaaactgaattttaaacaattgaggctgggtgcagtggctcatgcctgtaatcgaatataaggacttgagtataaaatttgaaaactacatggggaaatgtctttatcatgcatctcttgatagtctactgaaaactattaagtaaacctgcggtctgtaaacaaaaaaacccatagtgatacttaccttgtgtaatgtaaacaattttttaagctctttaaagtacatctagatttactggtaatgtatagaagtcaattttatccccaagcatttctacttcctaaaccattagcaagagtctcaaaacaacttcactaaactattggacctccagtgttaacttgccaacataaaaatctgaaaaactttgtaatcactatcaaaaatacaaaagagagaataaattcccaggtaaaaggctttacaaattttggaactattatgcttttgtttactaaacactgatccttttagtaattctgcagtattgcctcagactcccacaaagtttcaaaatagctcatctattagattcctgtaacatttatttgggataaacgtggttttgttgccgttgttcataatagaataaaatatttagctttgatggttcagatgtaatacaaagaaataactaagtttgggcctgagataaatgtggtaaagcaagaatgcagagatgctgtaatgatgagtgagttttatagcattactgaggacctgaaaacttgctgccaaggacactttgaaggttttgttggctggaagaagtgtctctggaatcccactcctagctcttcttgaatatttgaaaagaattagataagggccatggggacccaggtcaccccacctcttcttttcagtttggctacaacattggagtcatcagtgctcctgagacagtcatacaggactttctcagttacactttgaaagagaggtcagaagactctccctctgaggttttgctcatgtccccctggcccttgtctgtggccatcttccccaatggtgatatgattggctcctttctgttgcactctttgtcaaccactttggcaggtgcagttcaatgcttatcataatttgttggctattactggttgccttatgggattctgcagacaagctgagttggttgaaatgctgatcctgggccactagattactggcttgtaatgcggactctgcacaagttttgtgcccatgtacattggagagatctcgcctactcccctttggggtacctttagtgctctcaaccagctggacgtcgttggtattctggagatccagatctttggtctggagttcatcttggggtctgaagagctatgcccagtgatactgggctttaccatccttccagctgtcctataaagtgtagcccttccattttgccctggaagtcgtaagtttttgctcattaacagaaaggaagagtactaatgagatccttcagcaattgtaggggactcaggatgtgtcccaggacatctaggagataagagtgctaggatgatacaagctgtcatttccatcatgctccagctctctcagtagctctctggaatcaatgttgtcttctattactcaatgagaatcttcaaggatgcaggtgttgagaagccaatctatagattagtgcaggagtggttaatattatcttcttgactgtagtctctctgtttgtggttgaaagggcaggaaggactttacatatgataggtcttgaggcatggcgttttgttctgtcctcatgattgtttctttgttattaaaggatgagtatggtgggatgagctttgtctgtagtggggctatcttggtctttgtggccttctctgaagttggaccaagaactggctcaggatngccctcctgggatggnggggacccgaaaatgagga

SEQ ID NO: 345002 - DNA, 2948 bp, Homo sapiens
  misc_feature (20)..(20): n is a, c, g, or t
  misc_feature (23)..(23): n is a, c, g, or t
atccttaattaaattaatcnccnccccccccccaaatgagtgtacattattttgaatttaacttaactgttttgtggtgggtgtgaacaaaacattagaaatatattatctttttgtgataatactctctgacctcacttaaagtgatctgccatgaggtatccatgatcaagtttatgtttattctaatacctaaggaattcagccaactttgtttctatcatcagataatctcagaaaatagtgtgttttatctatattactgcctcttttcaatatttaagagaataattgtcttctggtttctactgagcctagtaataatcactaaagacctaaaaaaggaattccttctgttaagagtatttggatagcccattcacgataatggtggtgtgaaaatcaatcatcccagcttttctgacatatctaaattttgaataattaatttccacttccaaaaaattcaaatgttttctcaaagcagtcactacttatttgcattattcctgcatattcagtgaatgtgaggtcatatttggtattgtattagaagtagtgttggtcactggtcttgcctctttgaacattatttttatttgtaaaatgagggagttggtttgttatgatgggaaatgagtcagttttcagggtcctgagaaaattgcttcattcatggctgtgtttgagataactaaagtaaattttttttcaggtatttggtgtcatgttttggagttaatatttagtgcttatataattttaagttattacataatttttattggtatatatttgataggtactaggtattggattctcaccaaaccagtagaatggtattctctcttaatatgtgattgcctgtaatggccaggtagatataccttaaagtaatatgaaaggttttatatgtatattaaaatgtttgtacttttaaatctgtaaaggttatctggaatttttactgtgttaacttcagaattatatgggcattatgactttttcattgtacaaaaaattattcataaatgttagaatacagatgttccttgacttacaatagggttatgttccagtagacccattgtaaattgaaaataccgtaagttgaaaatacatttaatacgcctaacctactgaacatcccagcttagcctagcctatcttaaatgtgttctgaacacttaacgttggcctttagctgggcaaaatcatctaatacaaaacctattttataatgaagtgtttaatatctcaaataagagtattgtaccacatatcgttatcccaggataatatcagagtacaaaatttgaagtacagtttttaactgaatgtgtattgcttttgccccattataaagttgaaaaaccataagtcaaaccattgttaagtcggactgtttgtgttacatatatttgggattttttagtggccctttttaaaaagctgtttcttatttctgatcattgtgagtggggatagatgtgggaagaaccatgtctctactaaaaatacaaaaaatagccaggcttgttggcacacacctatagtcccagctactcgggagaccgaggcaggagaatcacttgaaccgggaggcagagggcagatcatgccactgtattccagcctgggcaacagagtaagactctgtctcaaaaatgaatgaatgaatgaatgaacgaatgaatgtactatgagctgatactgggatttcaggtaccgcagtttgtgctgaatgatatgtttggggtaaatcagtttttttcttatagaatttcggcgtttttgctgcaactgccactaattttgcatttaaaagaacaaaagaggaatgtatttttcaaaggagtgaatgaggttaaaatcaagattttgaatggtataaatatgcaactaattcagttgtaggatattattaaattttttattgctaaatatgtttctttcatacgttgcagtgcttacagttccaacagctttccaagaaaacatttccatatttgtgttatttgtaaagtatacataaataatgtaaaataatttgggattatttcaactttacattgtatgtctgaatttcatcgatgttgtacctggctcagtcaatagttgtcacaggtattaagccattttggaatttgccacttttttctgggtaacctgttttagtttagtttacagcatttagaaacagaaggtaactttatagaagtaacaccaatatcctagtctgcttgccccgaatataactaatagtattaggatgtaagcaatattaagatggtttttattattttttatacactgtgtgcttttactttttatttaaactacagcaaaaaactgattttttaactaaaattgaatggcgtttatcttaatgaccagttattgaccaaagtgtactcagaagatgttattatgtcccaatctaaggaatcctttaatttggggattaattttacttacacatgccatttcagtttcagttgcctcattctattacatcattcttgtcaagtctaagctttatcatgtctgaattcttttaacactgaatctgtgatgtaaaaatgtatgatgtgccataaattttattcataataaactaagttatagcctattgtaatctgtaaaacatttcttgtaaattacctaatttattttttcatttatgtacagtatcttatgtaaatttgaaaaatgtttgccatggcgcattctgtaaacattcccgtattcttttccttaatgcttatttgcatgaaggtaacttgggttttgcttgtttgtattggataaccattaagccaacttcagtttctctgcctttttttctgtagtttaaccatttctaattttgttcatattctaaatagatgttagaatcatactttttattttctactttctaaataaattatctaagttgtttacta

SEQ ID NO: 345003 - DNA, 2808 bp, Homo sapiens
  misc_feature (20)..(20): n is a, c, g, or t
  misc_feature (23)..(23): n is a, c, g, or t
atccttaattaaattaatcnccncccccccccctttatgtttattctaatacctaaggaattcagccaactttgtttctatcatcagataatctcagaaaatagtgtgttttatctatattactgcctcttttcaatatttaagagaataattgtcttctggtttctactgagcctagtaataatcactaaagacctaaaaaaggaattccttctgttaagagtatttggatagcccattcacgataatggtggtgtgaaaatcaatcatcccagcttttctgacatatctaaattttgaataattaatttccacttccaaaaaattcaaatgttttctcaaagcagtcactacttatttgcattattcctgcatattcagtgaatgtgaggtcatatttggtattgtattagaagtagtgttggtcactggtcttgcctctttgaacattatttttatttgtaaaatgagggagttggtttgttatgatgggaaatgagtcagttttcagggtcctgagaaaattgcttcattcatggctgtgtttgagataactaaagtaaattttttttcaggtatttggtgtcatgttttggagttaatatttagtgcttatataattttaagttattacataatttttattggtatatatttgataggtactaggtattggattctcaccaaaccagtagaatggtattctctcttaatatgtgattgcctgtaatggccaggtagatataccttaaagtaatatgaaaggttttatatgtatattaaaatgtttgtacttttaaatctgtaaaggttatctggaatttttactgtgttaacttcagaattatatgggcattatgactttttcattgtacaaaaaattattcataaatgttagaatacagatgttccttgacttacaatagggttatgttccagtagacccattgtaaattgaaaataccgtaagttgaaaatacatttaatacgcctaacctactgaacatcccagcttagcctagcctatcttaaatgtgttctgaacacttaacgttggcctttagctgggcaaaatcatctaatacaaaacctattttataatgaagtgtttaatatctcaaataagagtattgtaccacatatcgttatcccaggataatatcagagtacaaaatttgaagtacagtttttaactgaatgtgtattgcttttgccccattataaagttgaaaaaccataagtcaaaccattgttaagtcggactgtttgtgttacatatatttgggattttttagtggccctttttaaaaagctgtttcttatttctgatcattgtgagtggggatagatgtgggaagaaccatgtctctactaaaaatacaaaaaatagccaggcttgttggcacacacctatagtcccagctactcgggagaccgaggcaggagaatcacttgaaccgggaggcagagggcagatcatgccactgtattccagcctgggcaacagagtaagactctgtctcaaaaatgaatgaatgaatgaatgaacgaatgaatgtactatgagctgatactgggatttcaggtaccgcagtttgtgctgaatgatatgtttggggtaaatcagtttttttcttatagaatttcggcgtttttgctgcaactgccactaattttgcatttaaaagaacaaaagaggaatgtatttttcaaaggagtgaatgaggttaaaatcaagattttgaatggtataaatatgcaactaattcagttgtaggatattattaaattttttattgctaaatatgtttctttcatacgttgcagtgcttacagttccaacagctttccaagaaaacatttccatatttgtgttatttgtaaagtatacataaataatgtaaaataatttgggattatttcaactttacattgtatgtctgaatttcatcgatgttgtacctggctcagtcaatagttgtcacaggtattaagccattttggaatttgccacttttttctgggtaacctgttttagtttagtttacagcatttagaaacagaaggtaactttatagaagtaacaccaatatcctagtctgcttgccccgaatataactaatagtattaggatgtaagcaatattaagatggtttttattattttttatacactgtgtgcttttactttttatttaaactacagcaaaaaactgattttttaactaaaattgaatggcgtttatcttaatgaccagttattgaccaaagtgtactcagaagatgttattatgtcccaatctaaggaatcctttaatttggggattaattttacttacacatgccatttcagtttcagttgcctcattctattacatcattcttgtcaagtctaagctttatcatgtctgaattcttttaacactgaatctgtgatgtaaaaatgtatgatgtgccataaattttattcataataaactaagttatagcctattgtaatctgtaaaacatttcttgtaaattacctaatttattttttcatttatgtacagtatcttatgtaaatttgaaaaatgtttgccatggcgcattctgtaaacattcccgtattcttttccttaatgcttatttgcatgaaggtaacttgggttttgcttgtttgtattggataaccattaagccaacttcagtttctctgcctttttttctgtagtttaaccatttctaattttgttcatattctaaatagatgttagaatcatactttttattttctactttctaaataaattatctaagttgtttacta

SEQ ID NO: 345004 - DNA, 750 bp, Homo sapiens
gcacgaggggcaagcagactaggatataactaataatattgcttacatcctaatactattagttatattcggggcaagcagactaggtaagatggtttttattattttttatacactgtgtgcttttactttttatttaaactacagcaaaaaactgattttttaactaaaattgaatggcgtttatcttaatgaccagttattgaccaaagtgtactcagaagatgttattatgtcccaatctaaggaatcctttaatttggggattaattttacttacacatgccatttcagtttcagttgcctcattctattacatcattcttgtcaagtctaagctttatcatgtctgaattcttttaacactgaatctgtgatgtaaaaatgtatgatgtgccataaattttattcataataaactaagttatagcctattgtaatctgtaaaacatttcttgtaaattacctaatttattttttcatttatgtacagtatcttatgtaaatttgaaaaatgtttgccatggcgcattctgtaaacattcccgtattcttttccttaatgcttatttgcatgaaggtaacttgggttttgcttgtttgtattggataaccattaagccaacttcagtttctctgcctttttttctgtagtttaaccatttctaattttgttcatattctaaatagatgttagaatcatactttttattttctactttctaaataaattatctaagttgtttacta

SEQ ID NO: 345005 - DNA, 1593 bp, Homo sapiens
  misc_feature (196)..(196): n is a, c, g, or t
ggcggcggctccggggaccggggccttttgtttggagcggctgcgggggggccccggagcggcgaggccggcggccttccccagcttgctcggtcccggccacccctcgcgggggtggggggccgccccctgggccgggcatctcctcaggcgccgccgccccgccctaggccggccccgcccggcctgaggggangaaccggccgggcctcgccgcgcggcccagccacctccggagtcgccgcctctgctctcagtgccccggatcggaggccgtccatcgcccctcgggccgacgccatgaagatcaaagatgccaagaaaccctctttcccatggtttggcatggacattgggggaactctagtaaagctctcgtactttgaacctattgatatcacagcagaggaagagcaagaagaagttgagagtttaaaaagtattcggaaatatttgacttctaacgtggcatatggatccaccggcattcgggatgtacaccttgaactgaaagatttaacactttttggccgaagagggaacttgcactttatcaggtttccaacccaggacctgcctacttttatccaaatgggaagagataaaaacttctcaacattgcagacggtgctatgtgctacaggaggtggtgcttacaagtttgaaaaagattttcgcacaattggaaacctccacctgcacaaactggatgaacttgactgccttgtaaagggcttgctgtatatagactctgtcagtttcaatggacaagccgagtgctattattttgctaatgcctcagaacctgagcgatgccaaaagatgccttttaacctggatgatccctatccactgcttgtagtgaacattggctcaggagtcagtattttagcagtccattccaaagacaactataaacgagtgactgggacaagccttggagggggtacctttctgggtttatgcagtttattgactggctgtgaaagttttgaagaggctcttgaaatggcatccaaaggtgatagcacacaagctgacaagctggtccgtgatatttatggaggagattatgaaagatttggtttgccaggttgggctgtagcatctaggtaagtttaacatttgtgttatttaagttacagaagttaagtaattcaagttgcttatgtttttggaaagcaatgtaacagaaagttgtaagggtgctttctcttatccagtttaggttccaagttttgaacattgatgtcatttaaaaattaagtatacattaagaagtttaccctgagtgcgccttgtaagaaactttttttttttaatttttgagtgtctttccagtgtttatgcaaatacaaatacatatttttacttttctccccatatacaaaaggtaatctaccattatatggcatactatatatactctaaagtatccatatagaaatctttacatgttgttgaccttattttatacaggtgtaggataaattcccaaaagttggattgcaaatgcatttttgagatattgttaattatgcaaaagagcggtactgtttttcactctcaccagcggtaatatctatgctgctg

SEQ ID NO: 345006 - DNA, 2026 bp, Homo sapiens
  misc_feature (196)..(196): n is a, c, g, or t
ggcggcggctccggggaccggggccttttgtttggagcggctgcgggggggccccggagcggcgaggccggcggccttccccagcttgctcggtcccggccacccctcgcgggggtggggggccgccccctgggccgggcatctcctcaggcgccgccgccccgccctaggccggccccgcccggcctgaggggangaaccggccgggcctcgccgcgcggcccagccacctccggagtcgccgcctctgctctcagtgccccggatcggaggccgtccatcgcccctcgggccgacgccatgaagatcaaagatgccaagaaaccctctttcccatggtttggcatggacattgggggaactctagtaaagctctcgtactttgaacctattgatatcacagcagaggaagagcaagaagaagttgagagtttaaaaagtattcggaaatatttgacttctaacgtggcatatggatccaccggcattcgggatgtacaccttgaactgaaagatttaacactttttggccgaagagggaacttgcactttatcaggtttccaacccaggacctgcctacttttatccaaatgggaagagataaaaacttctcaacattgcagacggtgctatgtgctacaggaggtggtgcttacaagtttgaaaaagattttcgcacaattggaaacctccacctgcacaaactggatgaacttgactgccttgtaaagggcttgctgtatatagactctgtcagtttcaatggacaagccgagtgctattattttgctaatgcctcagaacctgagcgatgccaaaagatgccttttaacctggatgatccctatccactgcttgtagtgaacattggctcaggagtcagtattttagcagtccattccaaagacaactataaacgagtgactgggacaagccttggagggggtacctttctgggtttatgcagtttattgactggctgtgaaagttttgaagaggctcttgaaatggcatccaaaggtgatagcacacaagctgacaagctggtccgtgatatttatggaggagattatgaaagatttggtttgccaggttgggctgtagcatctagttttgggaatatgatttataaggagaagcgagaatctgttagtaaagaagatctggcaagagctactttagttactatcaccaataacattggttctgtggcacgaatgtgtgctgttaatgagaaaataaacagagttgtctttgttggaaactttttacgtgtcaataccctctcaatgaaacttttggcatatgcactggattactggtcaaaaggtcaactaaaagcattgtttctagaacatgagggttactttggagcagttggtgcacttcttgggctgccaaatttcagctaaagcatcaggtctctctctctgctaataaatgtcatccaagaggaactaaaaccagaggcattattactgcattgtttgtcactgggaaccaaaggataaaagagtagcataagctgctgaatgttgccatattaaaggagagaacttggtaacgtgaagtatttctcattgaaatgctttcccttttgtatatagccagtgttaaatccttaaatgcaatacagcctctgattattgagcttcctcttaaaaagatttttttattttatgtagccaacattgcagtactgtatgctcaaacacaaatcttaaagtatcggaactgtttagcttatgaaaataatcgactctgaatatttgttacaagtctgttttatgtgttttgattactagtgagcagaaaataacataccctgtattcaaaattactgaaatggcaatcaaagatgatcatttttatgtgattttagaaatgttaaggcaatactactaattattgtaggtttttttaacgtatcacccaaagcatgtatgtgatctttccccattagtatctttttctcaaatgccataattaactgaaatactattattaaattttcatgagaattct

SEQ ID NO: 345007 - DNA, 8240 bp, Homo sapiens
  misc_feature (55)..(55): n is a, c, g, or t
gcgacacgcagcggcggacgtactgtcgcagcccgtccgcctcgctcatggtacnggcgccctcacccgcagaaaccacctctaccatgccttattattaccctttgctgtttgaggagccagaaatagaggtgcagttagaggacggtcactttttccaacaaaacccactccatagccatgtggatttttatccaaaggctcaacaaccagagggaatggtgagacctgataactaaaatactgttattggcaagggtttgaaatgtgtaagaacctaggagggaaaggaagattgagcaacataggaaaaggggaagagaggctgagtgtcaccaaggtccaaactccatttataaaaatactgcaaaaccaggagttgatggtagaagtgcatatgatccatggcaggagtaaatctctccacctcctctaactctctgaaaactctagagttggagcaagtcttccatttgcttcttatccccttaaaagaatgccttccacttcccaacagcccccatcaagggaccccaagaggccaccatgctcttatctcgcactttctttcctattccccttgcctgaatctggagtggggttgagccctctgccttcaaccttaagatttaggaagttctttccccaactgtctaacttggaaaggtagatgagtctgaattttgaagtaacgaatgcaaattccactcagcagaggcaatgttatttatgtacatagggatagtggaatgagttttaatagattctgtccaaaaggggtttgttcctcttatttcctctatgtaggaagttgtgtcttaggcaactttatcagtatcaatggaaaaatgataggcactacaatgaaatggcaggatgccaatatgagatatttcaggaataataagaaatacagtttgtttgtataaaataaactatctcaagaaagttttcaacgacagtgatagtgttcatttgtaagagagagttctagaacttcgatgtccagtgcagtagccactacccatatgtagctgttgagcatttgaaatatggttagtccaaattgagatgtgctctaaaggacaataaaaggttaaatatctcctaattttttgtattgattacatgttgaaatgttaacattggaaatattgggttaaagaaaaatacacaattaaaatgaatcttggccaggcgcagtggctcacgcctctaatcccagcactttgagaggccagggtgggcaggtcacctgaggtcaggagttcgagaccagcctggccagtgtggcaaaaccctgcctactaaaaatacaaaaattagccaggcatggtggtgcgcacctgtagtcccagctacttgggaggctgaggcaggagaattgcttgaacccaggaggaggaggctgcagtgagctgagattgtgccactgcactccagcctgggcgacagagtgagactctgtctcaaaaaaaagaatcatctgtttccaattatttttaaatgtgcttactagaaaagataaaatcacacatggtttacattttatttctattaagacagcaccgttaagaacatagagctttgaggaattgtggtattagaaccaaatctatttaccacagtgagcttacagggagttactcgagatcttaataaaaaattataatctttggcagccttcattatgattttgtgttcttattattccagtacctctagattacatatgggaaaagctaaagagccacagtggtgagatggttgctcactctagcaggtaatttcagtttgaaaggataaaatatatgaatcatagttcacattaaccaaagtacagtgatgaaataacttagactctgaccattccatttttttcttaaagattgccctaaatctatagatgctaatacagtatttgccacaggtataaaacttgtagttactgtcattcaattaagattcttatctgtacagatatacaaatcagaaacttttaaaataaattgaactaatggaattttggctccaatatttagtcactacaatggaaatattaaagcaaggaacatgaagtcattgtagggttttaaaatggctactgactgacatgaattcagagtttcaaacagtctaaattctaaaaacttaactttacacgcttttcctcctaaataaccactctaataattcatacattcatatcttcaggtaaagaaaactgaattttaaacaattgaggctgggtgcagtggctcatgcctgtaatcgaatataaggacttgagtataaaatttgaaaactacatggggaaatgtctttatcatgcatctcttgatagtctactgaaaactattaagtaaacctgcggtctgtaaacaaaaaaacccatagtgatacttaccttgtgtaatgtaaacaattttttaagctctttaaagtacatctagatttactggtaatgtatagaagtcaattttatccccaagcatttctacttcctaaaccattagcaagagtctcaaaacaacttcactaaactattggacctccagtgttaacttgccaacataaaaatctgaaaaactttgtaatcactatcaaaaatacaaaagagagaataaattcccaggtaaaaggctttacaaattttggaactattatgcttttgtttactaaacactgatccttttagtaattctgcagtattgcctcagactcccacaaagtttcaaaatagctcatctattagattcctgtaacatttatttgggataaacgtggttttgttgccgttgttcataatagaataaaatatttagctttgatggttcagatgtaatacaaagaaataactaagtttgggcctgagataaatgtggtaaagcaagaatgcagagatgctgtaatgatgagtgagttttatagcattactgaggacctgaaaacttgctgccaaggacactttgaaggttttgttggctggaagaagtgtctctggaatcccactcctagctcttcttgaatatttgaaaagaattagataagggccatggggacccaggtcaccccacctcttcttttcagtttggctacaacattggagtcatcagtgctcctgagacagtcatacaggactttctcagttacactttgaaagagaggtcagaagactctccctctgaggttttgctcatgtccccctggcccttgtctgtggccatcttccccaatggtgatatgattggctcctttctgttgcactctttgtcaaccactttggcaggtgcagttcaatgcttatcataatttgttggctattactggttgccttatgggattctgcagacaagctgagttggttgaaatgctgatcctgggccactagattactggcttgtaatgcggactctgcacaagttttgtgcccatgtacattggagagatctcgcctactcccctttggggtacctttagtgctctcaaccagctggacgtcgttggtattctggagatccagatctttggtctggagttcatcttggggtctgaagagctatgcccagtgatactgggctttaccatccttccagctgtcctataaagtgtagcccttccattttgccctggaagtcgtaagtttttgctcattaacagaaaggaagagtactaatgagatccttcagcaattgtaggggactcaggatgtgtcccaggacatctaggagataagagtgctaggatgatacaagcaaagcaagtcactacactggcgctctttagagtacccagctaccaacaacccactgtcatttccatcatgctccagctctctcagtagctctctggaatcaatgttgtcttctattactcaatgagaatcttcaaggatgcaggtgttgagaagccaatctatagattagtgcaggagtggttaatattatcttcttgactgtagtctctctgtttgtggttgaaagggcaggaaggactttacatatgataggtcttgaggcatggcgttttgttctgtcctcatgattgtttctttgttattaaaggatgagtatggtgggatgagctttgtctgtagtggggctatcttggtctttgtggccttctctgaagttggaccagactccgttccctggaatactgtggccacactcttcagtttgcaatagcagtggctggttgctccaactggacctccaactttctagttggattgctcttcctgaacaattattatctagtttaagtgtgttgttgctttagggtcatggcatgcttatgtatttctgttaccatctgaccatggtactatgccaagttctcttaggggacctgaatctttccagtagaccacatttgagagagtatgagtcaactgggcatagttcccaacaacccaaaatacatacgtacttcactgaagcagatctcatgattccattgacttcatttctaaaattggactttgagcagccaatttctaaggattaaaaagaaactttaatgcattgtagacctctgtacacagaaaaatctttgtaacttttgggcttaattttcattcttaaaaaatctggtaactttttcaaatgcaaccactgtcagtttgctgtgaggctaggcaaacaacacaaggtatagaatttcccatcaccaccaccctgaccccgcgagaagattgccttttaattagagacttgtagaactagtgccttttaagttctacactcatcttttccaaagactattagtaaacttgccatgtaatttgacatggcagttccttgctcagctactctaaataaagttggaaattaggtggtctcttagtttgggtaaagtcagtactattgccagtaatatacatggtaattgaaagcccttaaagtggttcagattatttgccaaatattagactctataaaaatttctgaggttttttttcttttacctttgagtgtacatgtgattgctataatgtaaataccagtcccttaaagactgtttctataagcagaatgatgcagcacaaagtggaaaggttttcctcttattccagcagtattcttgccttcaaagagtagtccatcttgccttgatttttaaggttgttttcttggatggaaagcttaactggatagtaatttccatatgttctttataaccactctgtatattataagcaaagttttttcatattgtatctttttctgttgagcactttatgcattttagtctattgcatttgagaatgtagtttagaaattcactgtttaaagccatgtgaaaactgatagaggataatgaaaatgagtgtacattattttgaatttaacttaactgttttgtggtgggtgtgaacaaaacattagaaatatattatctttttgtgataatactctctgacctcacttaaagtgatctgccatgaggtatccatgatcaagtttatgtttattctaatacctaaggaattcagccaactttgtttctatcatcagataatctcagaaaatagtgtgttttatctatattactgcctcttttcaatatttaagagaataattgtcttctggtttctactgagcctagtaataatcactaaagacctaaaaaaggaattccttctgttaagagtatttggatagcccattcacgataatggtggtgtgaaaatcaatcatcccagcttttctgacatatctaaattttgaataattaatttccacttccaaaaaattcaaatgttttctcaaagcagtcactacttatttgcattattcctgcatattcagtgaatgtgaggtcatatttggtattgtattagaagtagtgttggtcactggtcttgcctctttgaacattatttttatttgtaaaatgagggagttggtttgttatgatgggaaatgagtcagttttcagggtcctgagaaaattgcttcattcatggctgtgtttgagataactaaagtaaattttttttcaggtatttggtgtcatgttttggagttaatatttagtgcttatataattttaagttattacataatttttattggtatatatttgataggtactaggtattggattctcaccaaaccagtagaatggtattctctcttaatatgtgattgcctgtaatggccaggtagatataccttaaagtaatatgaaaggttttatatgtatattaaaatgtttgtacttttaaatctgtaaaggttatctggaatttttactgtgttaacttcagaattatatgggcattatgactttttcattgtacaaaaaattattcataaatgttagaatacagatgttccttgacttacaatagggttatgttccagtagacccattgtaaattgaaaataccgtaagttgaaaatacatttaatacgcctaacctactgaacatcccagcttagcctagcctatcttaaatgtgttctgaacacttaacgttggcctttagctgggcaaaatcatctaatacaaaacctattttataatgaagtgtttaatatctcaaataagagtattgtaccacatatcgttatcccaggataatatcagagtacaaaatttgaagtacagtttttaactgaatgtgtattgcttttgccccattataaagttgaaaaaccataagtcaaaccattgttaagtcggactgtttgtgttacatatatttgggattttttagtggccctttttaaaaagctgtttcttatttctgatcattgtgagtggggatagatgtgggaagaaccatgtctctactaaaaatacaaaaaatagccaggcttgttggcacacacctatagtcccagctactcgggagaccgaggcaggagaatcacttgaaccgggaggcagagggcagatcatgccactgtattccagcctgggcaacagagtaagactctgtctcaaaaatgaatgaatgaatgaatgaacgaatgaatgtactatgagctgatactgggatttcaggtaccgcagtttgtgctgaatgatatgtttggggtaaatcagtttttttcttatagaatttcggcgtttttgctgcaactgccactaattttgcatttaaaagaacaaaagaggaatgtatttttcaaaggagtgaatgaggttaaaatcaagattttgaatggtataaatatgcaactaattcagttgtaggatattattaaattttttattgctaaatatgtttctttcatacgttgcagtgcttacagttccaacagctttccaagaaaacatttccatatttgtgttatttgtaaagtatacataaataatgtaaaataatttgggattatttcaactttacattgtatgtctgaatttcatcgatgttgtacctggctcagtcaatagttgtcacaggtattaagccattttggaatttgccacttttttctgggtaacctgttttagtttagtttacagcatttagaaacagaaggtaactttatagaagtaacaccaatatcctagtctgcttgccccgaatataactaatagtattaggatgtaagcaatattaagatggtttttattattttttatacactgtgtgcttttactttttatttaaactacagcaaaaaactgattttttaactaaaattgaatggcgtttatcttaatgaccagttattgaccaaagtgtactcagaagatgttattatgtcccaatctaaggaatcctttaatttggggattaattttacttacacatgccatttcagtttcagttgcctcattctattacatcattcttgtcaagtctaagctttatcatgtctgaattcttttaacactgaatctgtgatgtaaaaatgtatgatgtgccataaattttattcataataaactaagttatagcctattgtaatctgtaaaacatttcttgtaaattacctaatttattttttcatttatgtacagtatcttatgtaaatttgaaaaatgtttgccatggcgcattctgtaaacattcccgtattcttttccttaatgcttatttgcatgaaggtaacttgggttttgcttgtttgtattggataaccattaagccaacttcagtttctctgcctttttttctgtagtttaaccatttctaattttgttcatattctaaatagatgttagaatcatactttttattttctactttctaaataaattatctaagttgtttacta

SEQ ID NO: 345008 - DNA, 2252 bp, Homo sapiens
  misc_feature (196)..(196): n is a, c, g, or t
ggcggcggctccggggaccggggccttttgtttggagcggctgcgggggggccccggagcggcgaggccggcggccttccccagcttgctcggtcccggccacccctcgcgggggtggggggccgccccctgggccgggcatctcctcaggcgccgccgccccgccctaggccggccccgcccggcctgaggggangaaccggccgggcctcgccgcgcggcccagccacctccggagtcgccgcctctgctctcagtgccccggatcggaggccgtccatcgcccctcgggccgacgccatgaagatcaaagatgccaagaaaccctctttcccatggtttggcatggacattgggggaactctagtaaagctctcgtactttgaacctattgatatcacagcagaggaagagcaagaagaagttgagagtttaaaaagtattcggaaatatttgacttctaacgtggcatatggatccaccggcattcgggatgtacaccttgaactgaaagatttaacactttttggccgaagagggaacttgcactttatcaggtttccaacccaggacctgcctacttttatccaaatgggaagagataaaaacttctcaacattgcagacggtgctatgtgctacaggaggtggtgcttacaagtttgaaaaagattttcgcacaattggaaacctccacctgcacaaactggatgaacttgactgccttgtaaagggcttgctgtatatagactctgtcagtttcaatggacaagccgagtgctattattttgctaatgcctcagaacctgagcgatgccaaaagatgccttttaacctggatgatccctatccactgcttgtagtgaacattggctcaggagtcagtattttagcagtccattccaaagacaactataaacgagtgactgggacaagccttggagggggtacctttctgggtttatgcagtttattgactggctgtgaaagttttgaagaggctcttgaaatggcatccaaaggtgatagcacacaagctgacaagctggtccgtgatatttatggaggagattatgaaagatttggtttgccaggttgggctgtagcatctagttttgggaatatgatttataaggagaagcgagaatctgttagtaaagaagatctggcaagagctactttagttactatcaccaataacattggttctgtggcacgaatgtgtgctgttaatgagaaaataaacagagttgtctttgttggaaactttttacgtgtcaataccctctcaatgaaacttttggcatatgcactggattactggtcaaaaggtcaactaaaagcattgtttctagaacatgagggttactttggagcagttggtgcacttcttgggctgccaaatttcagctaaagcatcaggtctctctctctgctaataaatgtcatccaagaggaactaaaaccagaggcattattactgcattgtttgtcactgggaaccaaaggataaaagagtagcataagctgctgaatgttgccatattaaaggagagaacttggtaacgtgaagtatttctcattgaaatgctttcccttttgtatatagccagtgttaaatccttaaatgcaatacagcctctgattattgagcttcctcttaaaaagatttttttattttatgtagccaacattgcagtactgtatgctcaaacacaaatcttaaagtatcggaactgtttagcttatgaaaataatcgactctgaatatttgttacaagtctgttttatgtgttttgattactagtgagcagaaaataacataccctgtattcaaaattactgaaatggcaatcaaagatgatcatttttatgtgattttagaaatgttaaggcaatactactaattattgtaggtttttttaacgtatcacccaaagcatgtatgtgatctttccccattagtatctttttctcaaatgccataattaactgaaatactattattaaattttcatgagaattctaaaatgaatcctgggaaatgcacgtttggtgatgttgcactttctgtattttacaggaattagtcaatacatgttgaaatgtttaacattttaagattggaggcttaattactgggagtctgtctaatgaagtcctgggactataggcttgagccaccacggctggatgaatcataaattgtaaacctgaataaaatgctgcaacctccaatgagaggaaaataaa

SEQ ID NO: 345009 - DNA, 378 bp, Homo sapiens
tccacacacatcctcagacccatgctaagaggtacatcatgcccgtgtcttcataaagtgacctctcctttgccatttcagtcatccgcaacactctcctttgtggtaggaatatccctcctattgtgggtggtggggggaggggaatatgtgtgagaagtttgtccaggctcacacagctgccttattccagcacttctgtgggatgcgttcttcccattacgtcaaaacttccacccacatgcctgtaaagtagcaaatggagtgtctgtataaaaattctcaggttcacttcatttggcaattatctggttaatttgatcaaccaagctctaagtgtcttactgggatattatgcatttatagctttgtctgccc

SEQ ID NO: 345010 - DNA, 327 bp, Homo sapiens
ctcggcctcccaaagtgctgggattacaggcgtgacccaccgtgcctggccagaaacatttataatttctagactgtaaaatagcggaggcgattggccttctagatgcatagcaaggtgtgaccccacctgctgcactctgcctttcattgtccagacctaacttctcctgtcttctgtagtgtacgttcagtgataccacaaggaaggaataatgtgggacaccctgcaaaataaatggcctagtttccccaacaatgaatcagtggcactcttttaaagggtggtagtgatgggcgatggggattgttacataaaaaaagagac

SEQ ID NO: 345011 - DNA, 1227 bp, Homo sapiens
catcaaataaagggaagcggaaaacaccaccatcactatggatagtattgacattgggaaataattactaacatatctgtcacctctctgtctggccggctagggcccaacaaagtcagagccacgtgcaaatcactctatgttaaacggagaatgccacagtatgagtgacatttgctctgaagagagtcacccagagtaacttaaattgtgttcagtaagttctgtttcaaaatccattttaatacaaacttcaccaaaaaaatggctacaatgaagtctctatacttatgagaaaaggtgcaaaaagccacaaggatgttctttgcagcgctattcaaaatagtgaaaaattagaatgccacctaagtatctaaaaaggagatcagttaaataaaagtatttctacaaaatactatttagcaattttaaaatataattcaattatttactaatacagaaaaatattaatggtatatttcacatgaaaaaggtaggccatgaaacatgattatggtttgataccttttctttctttctttttttttttttttttttttttgagaaagggttttactctctcacccaggctggagtgcagtggtgccatctcggctcactgcagcttcgacctgctgggctcaagtgatactcctgcttcacttttttgtgaccagtgcactcacaccagcctcccaagtagctgggactacaggcatgcacctccaaacctggctaatttttttactttttggcaaagatgaggtctccctatgttgcccaggctggtctcgaactcctgggctcaagcgatcttcccatcttggcctcccaaagtgctgggattacagacatgagccactgtgcctggccagtacatattttttttttatcataaatgttattttcaaaaatactgaaatatgatttaaaaactgccaaaaatatcagcttagataatatcctctaaaaatatcctagggagaacctgagttcttaatccatataaaaaaggagcagtcttaaaattaagtaggtaagtaggctcttctccctatgtgtctgcatctttctgttgtccatccctagtagattagggcccttctgcagtcttccctttagcaaaaatctacattcagcaaaggatctgaatcatatcaatgacatgaagtagatgattactcatggtgtataagtattttactagggatcaaaggcttaagccaa

SEQ ID NO: 345012 - DNA, 718 bp, Homo sapiens
gactatttgagctctaagtataggatcatgaataccattgagaaatgaaggcaaacccgaaaatcactgaggaaaagtatataatttgatagtcactgttgacatgtatgattatacttaggaaacaaaacaaatattaaaataattttaattatgaggaacttggaagattcctgtaaagactccattcactttagcttcttcagtaactttaagtggaagagtccaagaaaaccacaaacaaggtagggataccatgtcacctctaatgcgtgaggagaaatattcttaggaatagtagagtactgtcaaggtgggaagtcctgagttactttagatttctacaatttattaattttagataataattatcaatgttaattttttaaaaaagttagttaagacagattttttcctttctaaatagaagtaaaataatgtataaatggaaagtaaaatacaaataaaaaagaacaagtgctcaggaagaaactgtagaaaccaataataaaagcctatagtcatcactaaataaagagacaaagatcacaacttctggatacagaaattaacaaaaagagactgtttctaatgtcgagaaagcttggcattcagtgttaaatgtcataacctttgttccctttttctttttttgtgctggtttcaattggtacagcatgtcttttgtaggaaataatcagtgcatttaactaaaaat

SEQ ID NO: 345013 - DNA, 525 bp, Homo sapiens
agctcccactggccaaacttaagacatttgagcatcaaacggataaataaaaagtagtcacagattttgacttaaaaaaaggacttcttgatattacaatagaggcagttagggtgaaagggaaagcactttttttttaagagaacaatgccaactaataaatgcaaaagaaggaatagatttggaaaatcattatttttgtaatccctaatgtaataagtgattcggacaggatcatcaatgaatgttaacacaattagatgaaatatagctggcatataggatatttacattattacaaaatatctcacagttattaattacagaaggaaaaagatttatttatgatggagaaatctagtcaatattgccttaagtgatcaaacttggcatcacaacaatgagatgcaccgatattttgtgcctcctgatttgatggaacttgactctagtcatgagggaaaaaaaatcaagcaattccagatatatgacattttacaaggcagcttgctgggactccagatt

SEQ ID NO: 345014 - DNA, 571 bp, Homo sapiens
ctgagcaatgagggtgttggctaaagacaacagcgtcttgatgggaaaggaggagcaatgggaaagactggagtatctcagtccctctcagtggatgggggttgtgggagagaggcagctgggagacaggcctccctctggagttcatagctgagttgctgtccaaatcagtggtccctagaatctataaaacaaaactgagaacttcagaggtgcatccagagaagccacactccaaaaggaccacttccaggtaagcatgacacactgctgggtgcacacactcctggcttcagattccaggatctttctcactgccttcaaccccagctagtaatagggagacccttcccctggagcctgggtggtgactcggagatctactggtcagcacagagagctggggcaggaatacacatctgcagtgatgagggatatggagcagtgacctcatggccagggcatggttaacggtatctttgccactcccaagctagcccatggctgccggatcttcctctgcttgatctcctagctgacctgtgcaaccctaggtagtccagaaattcca

SEQ ID NO: 345015 - DNA, 1755 bp, Homo sapiens
ctgagcaatgagggtgttggctaaagacaacagcgtcttgatgggaaaggaggagcaatgggaaagactggagtatctcagtccctctcagtggatgggggttgtgggagagaggcagctgggagacaggcctccctctggagttcatagctgagttgctgtccaaatcagtggtccctagaatctataaaacaaaactgagaacttcagaggtgcatccagagaagccacactccaaaaggaccacttccagccccagacgccatgcggcaaaccctaccgctgctgctgctgacggtgctgcgccccagctgggcagaccctccccaggagaaggtcccgctcttccgggtcactcagcagggcccctgggggagcagtggcagcaacgccaccgactcgccctgcgaggggctgcccgccgcggatgcgacggccttgaccctggcgaaccgcaacctggagcgcctgcccggctgcctaccgcgcacactgcgcagcctcgacgccagccacaacctgctgcgcgccctgagcacttccgagctcggccacctggagcagctgcaggtgctgaccctgcgccacaaccgcatcgccgcgctgcgctggggcccgggtgggccggcggggctgcacaccctggacctcagctacaaccagctggccgctctgccgccgtgcaccgggcccgcgctgagcagcctccgcgccctggcgctcgccgggaatccgctgcgggcgctgcagccccgggccttcgcctgcttccccgcgctgcagctcctcaacctctcctgcaccgcgctgggtcgcggagcccaggggggcatcgccgaggcggcgttcgctggagaggatggcgcgcccctggtcacgctcgaagtcctggatctcagcggcacgttccttgaacgggtgagtcaggtggatcagagacctgccgtaacgcctcaatcatccacttcgtaatcctgcagggagagattgccgttcgtgcgtgaccggagctcctgcgtaggaggtgcgagcgagttgtctcgaatgatatgatcactccccaaaactggcacgcagacatggacgtgtctaggatctccgcacagccagctgttgcttctgtcgccacacacatctttcaagatactccacatctacaggtccttctgttccagaagtaagtgcttctgaggcacatcttcatcacatgactgatttttgcccattacgctatgttgaattttatagaacaaaccagaccttaatttttctcccactactcttccaaatcctctctggggctttgttttcccccaccctttgggtgatatcttgggtaggtcccagatagtccacccagccatctagccttgcaacgtcagtccagttcagagtagcattagaacgccaaactcctatgcctttaaagtttattttaagcccagtcttagaaatttacagtgggaagaggtgaggaggacctcaggtctcctctctgtctggatctgctttcttccccacatgtcatgcaagttcagtcccttccagaatttgagtgggtctagggatgaaagtattgatattgttagaaaatcccttggaagtctatgggcaggccctgttagtcctcttttacacaatgcagtcactaaagatggaattattcttctaaaaggatgaacaacttttcaaagcaaaggcagaaccattcactcattctgtcctttattcaataaatagctattgagcacacga

SEQ ID NO: 345016 - DNA, 813 bp, Homo sapiens
ggggcacgttctccatgtattaggagagccacaaaatgaggtttctgggggcccctcgcctccttaattacgttccgcagaagttccccacacttgacagacatcagagcaaagtctggttattttctgtgtggactttaatgagaaggtggagcagcaacagacttggagacagtgtcctgggttcaagccttgtctctgccgctttccagctatgtagccttgggccaatcaatcccctctctggccttggccgactcagattggaagaaaggaaggactgcttgtccctgagcacccttccagctgaaatgaccacaattctgagattcccagagctgctaactgtgcccgtgctcagcgatgaccttcaccattcaccttgccactctcgttcttccttcatgccgtgctggcctcctgggtttgtgcgttctggagtagttggcagtttcccttctgtgtttcagttgagtcagggtggatcagagacctgccgaagctcacatccctctacctgaggaagatgcctcggctgacgaccctggagggggacattttcaagatgacccccaacctgcagcagctggactgtcaggactccccagcacttgcttctgtcgccacacacatctttcaagatactccacatctacaggtccttctgttccagaagtaagtgcttctgaggcacatcttcatcacatgactgatttttgcccattacgctatgttgaattttatagaacaaaccagaccttaatttttctcccactactcttccaaatcctctctggggctttgttttccccc

SEQ ID NO: 345017 - DNA, 1711 bp, Homo sapiens
ctgagcaatgagggtgttggctaaagacaacagcgtcttgatgggaaaggaggagcaatgggaaagactggagtatctcagtccctctcagtggatgggggttgtgggagagaggcagctgggagacaggcctccctctggagttcatagctgagttgctgtccaaatcagtggtccctagaatctataaaacaaaactgagaacttcagaggtgcatccagagaagccacactccaaaaggaccacttccagccccagacgccatgcggcaaaccctaccgctgctgctgctgacggtgctgcgccccagctgggcagaccctccccaggagaaggtcccgctcttccgggtcactcagcagggcccctgggggagcagtggcagcaacgccaccgactcgccctgcgaggggctgcccgccgcggatgcgacggccttgaccctggcgaaccgcaacctggagcgcctgcccggctgcctaccgcgcacactgcgcagcctcgacgccagccacaacctgctgcgcgccctgagcacttccgagctcggccacctggagcagctgcaggtgctgaccctgcgccacaaccgcatcgccgcgctgcgctggggcccgggtgggccggcggggctgcacaccctggacctcagctacaaccagctggccgctctgccgccgtgcaccgggcccgcgctgagcagcctccgcgccctggcgctcgccgggaatccgctgcgggcgctgcagccccgggccttcgcctgcttccccgcgctgcagctcctcaacctctcctgcaccgcgctgggtcgcggagcccaggggggcatcgccgaggcggcgttcgctggagaggatggcgcgcccctggtcacgctcgaagtcctggatctcagcggcacgttccttgaacgggtgagtcaggttgagtcagggtggatcagagacctgccgaagctcacatccctctacctgaggaagatgcctcggctgacgaccctggagggggacattttcaagatgacccccaacctgcagcagctggactgtcaggactccccagcacttgcttctgtcgccacacacatctttcaagatactccacatctacaggtccttctgttccagaagtaagtgcttctgaggcacatcttcatcacatgactgatttttgcccattacgctatgttgaattttatagaacaaaccagaccttaatttttctcccactactcttccaaatcctctctggggctttgttttcccccaccctttgggtgatatcttgggtaggtcccagatagtccacccagccatctagccttgcaacgtcagtccagttcagagtagcattagaacgccaaactcctatgcctttaaagtttattttaagcccagtcttagaaatttacagtgggaagaggtgaggaggacctcaggtctcctctctgtctggatctgctttcttccccacatgtcatgcaagttcagtcccttccagaatttgagtgggtctagggatgaaagtattgatattgttagaaaatcccttggaagtctatgggcaggccctgttagtcctcttttacacaatgcagtcactaaagatggaattattcttctaaaaggatgaacaacttttcaaagcaaaggcagaaccattcactcattctgtcctttattcaataaatagctattgagcacacga

SEQ ID NO: 345018 - DNA, 1662 bp, Homo sapiens
ctgagcaatgagggtgttggctaaagacaacagcgtcttgatgggaaaggaggagcaatgggaaagactggagtatctcagtccctctcagtggatgggggttgtgggagagaggcagctgggagacaggcctccctctggagttcatagctgagttgctccccagacgccatgcggcaaaccctaccgctgctgctgctgacggtgctgcgccccagctgggcagaccctccccaggagaaggtcccgctcttccgggtcactcagcagggcccctgggggagcagtggcagcaacgccaccgactcgccctgcgaggggctgcccgccgcggatgcgacggccttgaccctggcgaaccgcaacctggagcgcctgcccggctgcctaccgcgcacactgcgcagcctcgacgccagccacaacctgctgcgcgccctgagcacttccgagctcggccacctggagcagctgcaggtgctgaccctgcgccacaaccgcatcgccgcgctgcgctggggcccgggtgggccggcggggctgcacaccctggacctcagctacaaccagctggccgctctgccgccgtgcaccgggcccgcgctgagcagcctccgcgccctggcgctcgccgggaatccgctgcgggcgctgcagccccgggccttcgcctgcttccccgcgctgcagctcctcaacctctcctgcaccgcgctgggtcgcggagcccaggggggcatcgccgaggcggcgttcgctggagaggatggcgcgcccctggtcacgctcgaagtcctggatctcagcggcacgttccttgaacgggtgagtcaggtggatcagagacctgccgtaacgcctcaatcatccacttcgtaatcctgcagggagagattgccgttcgtgcgtgaccggagctcctgcgtaggaggtgcgagcgagttgtctcgaatgatatgatcactccccaaaactggcacgcagacatggacgtgtctaggatctccgcacagccagctgttgcttctgtcgccacacacatctttcaagatactccacatctacaggtccttctgttccagaagtaagtgcttctgaggcacatcttcatcacatgactgatttttgcccattacgctatgttgaattttatagaacaaaccagaccttaatttttctcccactactcttccaaatcctctctggggctttgttttcccccaccctttgggtgatatcttgggtaggtcccagatagtccacccagccatctagccttgcaacgtcagtccagttcagagtagcattagaacgccaaactcctatgcctttaaagtttattttaagcccagtcttagaaatttacagtgggaagaggtgaggaggacctcaggtctcctctctgtctggatctgctttcttccccacatgtcatgcaagttcagtcccttccagaatttgagtgggtctagggatgaaagtattgatattgttagaaaatcccttggaagtctatgggcaggccctgttagtcctcttttacacaatgcagtcactaaagatggaattattcttctaaaaggatgaacaacttttcaaagcaaaggcagaaccattcactcattctgtcctttattcaataaatagctattgagcacacga

SEQ ID NO: 345019 - DNA, 599 bp, Homo sapiens
aactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatgatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagtattcttcagaggaggaagaagttgatcttcagacagcccttacagggtatcaaacaaaacagcgaaagcttctagaaccagttgatcatggaaaaattgagtatgagccatttaggaaaaacttctatgttgaagttccagaactagcaaaaatgtctcaagaagg

SEQ ID NO: 345020 - DNA, 460 bp, Homo sapiens
aaataatcagaaaacaaatgaagatgtagaagacttaacactatcaactaacttgacagaaatgacatatataatacacttcacttgacaataacagaagacacactttttcgagtgcacatagaacatttaccaaaatagactataggctgagatggagagtaagtctcaaaaaacttacaataatttaaataatccagagtactaatactaatatgaatggtcatactaatttgaaattaaattataagtcagtaacagaaagatgcggaaaatatgcaaattcttagaaatgtaaaactcacttctaataagccacaggtcaaagaagaaatcacaaaggggatggaaacatatttgaacctaatgaaaatgaccatacaacatgtcaaagcttgtgagatgcagctaagcagtgtttgaaggatatttatagctttaaatgcttatattagaaaag

SEQ ID NO: 345021 - DNA, 818 bp, Homo sapiens
  misc_feature (1)..(1): n is a, c, g, or t
  misc_feature (64)..(64): n is a, c, g, or t
naggtcgcatcctcacacacgaaaatttacacattcaagaccccattcttcaccgtgtagagtntattcaaggaatggttccccaaataagttcagatcttcttcaaatcccccttagcacctctggtactgtaccgtaccttgcctttctgtccaggtttggtggaattgacctatatataaatggtataaagaggggaggtgggaatgaaatgaattgctgccgcacattaagagaacttgaaatccaagtgggagaaaaggttttcaaaaacattaagactgttatgaaagcctttgagctcattgatgttaacaagactggactggttcgaccgcaggagctaagaagggttctggagaccttctgtatgaagttaagagacgaggaatacgaaaagttttcgaaacactacaacatccacaaggatactgcagtagattacaacgtgtttttgaagaatctcagcataaataacgacttgaaccttagatattgtatgggaaatcaagaggtctcattggagaatcaacaagccaaaaattccaaaaaggaacgtttgctaggttctgcatcatctgaagatatctggagaaactactccttggatgaaattgagaggaacttttgtctacaagtaagatgttttcctaagccacaattacctacagagtaaacacagcaaagtagacaatatggaaaactattaggtttacacattatttctaaaatttgtttcgatcctacctatgtcttctccaatactgagaccccctctacctcccaataacagcaatacattgatcatggataatcg

SEQ ID NO: 345022 - DNA, 848 bp, Homo sapiens
ggctcatcgcagaggattggaagggcctagattactgcccaatgacaaaagtgtgggcttaatgtcctcactcttcagggagagaatgtggactttagcatttgaactgaatatttgagattgaagatttctgaataatcccccttagcacctctggtactgtaccgtaccttgcctttctgtccaggtttggtggaattgacctatatataaatggtataaagaggggaggtgggaatgaaatgaattgctgccgcacattaagagaacttgaaatccaagtgggagaaaaggttttcaaaaacattaagactgttatgaaagcctttgagctcattgatgttaacaagactggactggttcgaccgcaggagctaagaagggttctggagaccttctgtatgaagttaagagacgaggaatacgaaaagttttcgaaacactacaacatccacaaggatactgcagtagattacaacgtgtttttgaagaatctcagcataaataacgacttgaaccttagatattgtatgggaaatcaagaggtctcattggagaatcaacaagccaaaaattccaaaaaggaacgtttgctaggttctgcatcatctgaagatatctggagaaactactccttggatgaaattgagaggaacttttgtctacaagtaagatgttttcctaagccacaattacctacagagtaaacacagcaaagtagacaatatggaaaactattaggtttacacattatttctaaaatttgtttcgatcctacctatgtcttctccaatactgagaccccctctacctcccaataacagcaatacattgatcatggataatcg

SEQ ID NO: 345023 - DNA, 513 bp, Homo sapiens
atgtctctctccttccttcctcctttccttcgcctcattgatctgtttcccgttaccttttaccttacagtgatattaggagtggcaccacctttaaatggaaagattatttcttttaattaaatacttctgttaccaacaggtattgagaaacagtattggcagaaaagttgtcatgatcttaactggttcaatggcttttccaatcattaaagctttttctcccttctagacttcttactaataaagtcaggaataatgcttcctccctgcacatattaattactctacagtcaatgaagctgaagagattgagttgaagaaattgcaaatattttaaggagttattaccataaaaagtttaaatactctctggtagtggcaaggaatttatttcctttataaaatctccccctctatgtcctccaccctcgtgtgtattcaggttaactaatttcacacgatgaaacttgctcagctgcgtgaaaaataaatactttaaaaaatatcatc

SEQ ID NO: 345024 - DNA, 631 bp, Homo sapiens
ctataagcaatggatctttgacctagttgacaaagatatacattggagaaaggacaccctattcaataaatggtgctgggaaaattgggtagctatatgcagaaggatgaaaactggactcacacctttcaccatatgcaaaaattaactcaaggttgattgaagatttaaatgtaagacctgaaactattaaaatcctataagaaaaactgggaaaaactcttctggacatgggtttaggcaaataatttatgaccatgtcttcaaaatgaaatgcaacataaacaaaaatagataaatggaacttaattaaactaaaaagcttcttctcagcaaaagaaacaatcaacagtgtaaacagacaacttacagaatggaaaaaaaatttgcaagctatgcatccaacaaagggctaatatccagaatctacaaggaactcaaacaactcaacaagaaaaaaaaaaaaaagtaacctcattaaaaaaatctccatgctgttttccaaacaggttgccccgtttcaggtttcagattgtcctttttggagatttctgtaagaactaaaaatagaactatcattcgatccagcaatcccattactggatatgtacccaaagggaaagaaattatt

SEQ ID NO: 345025 - DNA, 286 bp, Homo sapiens
tatatcaaatcctaggaagtggtgtaaaatactttattttacattttcacagggaaaaaaacaatagattttagattaagaaatataaaatacacttccaataaaatgttttataaactcactattttgttaacaaagcttggtttaaacccaggagtgggataactgaatgatgtggtggaagaggcccccccaaaaaaacagaaattatacatttaaaaaataactaagagtagaattggattgtttgtaacacaaaggataaatacttgaggagatggatacc

SEQ ID NO: 345026 - DNA, 3231 bp, Homo sapiens
tgcttcctggagcatttttttccccttagagctgttcgctgttttccctgtcacgccgcttttctgaaagacgggttgtgcgctttgggcttattcctggacggtccccaaaggtccccgaaaggaccaggcccggacacgtggggccttggtttccggccggaagtcccgggaggtgtagggctagagttctggccgtggcgggccggtttctgcgtgctgcgtgcgcggccgcgtgggctatggggcggcggtcgcggggtcggcggctccagcaacagcagcggccggaggacgcggaggatggcgccgagggtggtggaaagcgcggcgaggcgggctgggaaggaggctaccccgagatcgtcaaggagaacaagctgttcgagcactactaccaggagctcaagatcgtgcccgagggcgagtggggccagttcatggacgctctcagggagccgctcccggccactttaagaattactggttacaaaagccacgcaaaagagattctccattgcttaaagaacaaatattttaaggaattggaggacctggaggtggacggtcagaaagttgaagttccacagccactgagttggtatcctgaagaacttgcctggcacacaaatttaagtcgaaaaatcttgagaaaatcgccacacttggaaaagtttcatcagtttctagttagtgaaacagaatctggaaatattagtcgtcaagaagctgttagcatgatcccaccactgctcctcaacgtgcggcctcatcataagatcttagatatgtgtgcagcacctggctcaaagaccacacagttaattgaaatgctacatgccgacatgaatgtcccctttccagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatcgaattttatgtgatgtcccttgcagtggagacggcactatgagaaaaaacattgatgtttggaaaaagtggaccaccttaaatagcttgcagctacatggcttacagctgcggattgcaacacgcggggctgaacagctggctgaaggtggaaggatggtgtattccacgtgttcactaaaccctattgaggatgaagcagtcatagcatctttactggaaaaaagtgaaggtgctttggagcttgctgatgtgtctaatgaactgccagggctgaagtggatgcctggaatcacacagtggaaggtaatgacgaaagatgggcagtggtttacagactgggacgctgttcctcacagcagacacacccagatccgacctaccatgttccctccgaaggacccagaaaagctgcaggccatgcacctggagcgatgccttaggatattaccccatcatcagaatactggagggttttttgtggcagtattggtgaaaaaatcttcaatgccgtggaataaacgtcagccaaagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtggtcctcctccatcaaagaaaatgaagttatttggatttaaagaagatccatttgtatttattcctgaagatgacccattatttccacctattgagaaattttatgctttggatccttcattcccaaggatgaatttgttaactcggactacagaagggaagaaaaggcagctctacatggtttctaaggagttgcggaatgtgctgctgaataacagtgagaagatgaaggttattaacacggggatcaaagtctggtgtagaaataacagcggtgaagagtttgactgtgctttccggctggcacaggagggaatatatacattgtatccatttattaactcaagaattattactgtatcaatggaagatgttaagatactgttgacccaggaaaatcccttttttagaaaactcagcagtgagacctacagtcaagcaaaggacctggcaaagggaagcatcgtgctgaagtatgaaccagattctgcgaatccagacgctctgcagtgtcccatcgtcttatgcggatggcggggaaaggcctccattcgaacttttgtgcccaagaatgaacggcttcattatctcaggatgatggggctggaggtattgggagaaaagaagaaggaaggggttatcctcacaaatgagagtgcagccagcaccggacagccagacaatgacgtgactgagggacagagagcaggagagcccaacagcccagatgcagaagaggccaacagtccagacgtgacagcaggctgtgacccggcgggggtccatccaccccggtgagcaggcccaaggcagcgggggcccacacccctcacacgcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtcttaaggtgcagtattttttaaattattatttatagaaagaatctataaattcttggggaagtgtgttataagctttaataattacattgagctgcacctcagtggtgtgtcattaacatgcagtggggttaatatctgaggcctcagatgactttgtgccttttggaataaagggtaaaataaactctcccagagtaagagctgtatcgtgaattgtcatactaattattgagggggacttatgtgcttttattgaatggagtgctttacaatttttatttttaaatggggttgggatccttggaatatttcaataaaattgataaaata

SEQ ID NO: 345027 - DNA, 2948 bp, Homo sapiens
  misc_feature (35)..(35): n is a, c, g, or t
gatcccctcccccaccacacaacgaggaaaaacgntctctatcgaaaatatttgtgcctcaccccctgcactggacagaacagctgccacccaatgtttggtttttctccaccctgcgccttcaacccattcctgtctccccactccagcctgcttacttcatccagggccttgctgtctcttgcccactttaagaattactggttacaaaagccacgcaaaagagattctccattgcttaaagaacaaatattttaaggaattggaggacctggaggtggacggtcagaaagttgaagttccacagccactgagttggtatcctgaagaacttgcctggcacacaaatttaagtcgaaaaatcttgagaaaatcgccacacttggaaaagtttcatcagtttctagttagtgaaacagaatctggaaatattagtcgtcaagaagctgttagcatgatcccaccactgctcctcaacgtgcggcctcatcataagatcttagatatgtgtgcagcacctggctcaaagaccacacagttaattgaaatgctacatgccgacatgaatgtcccctttccagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatcgaattttatgtgatgtcccttgcagtggagacggcactatgagaaaaaacattgatgtttggaaaaagtggaccaccttaaatagcttgcagctacatggcttacagctgcggattgcaacacgcggggctgaacagctggctgaaggtggaaggatggtgtattccacgtgttcactaaaccctattgaggatgaagcagtcatagcatctttactggaaaaaagtgaaggtgctttggagcttgctgatgtgtctaatgaactgccagggctgaagtggatgcctggaatcacacagtggaaggtaatgacgaaagatgggcagtggtttacagactgggacgctgttcctcacagcagacacacccagatccgacctaccatgttccctccgaaggacccagaaaagctgcaggccatgcacctggagcgatgccttaggatattaccccatcatcagaatactggagggttttttgtggcagtattggtgaaaaaatcttcaatgccgtggaataaacgtcagccaaagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtggtcctcctccatcaaagaaaatgaagttatttggatttaaagaagatccatttgtatttattcctgaagatgacccattatttccacctattgagaaattttatgctttggatccttcattcccaaggatgaatttgttaactcggactacagaagggaagaaaaggcagctctacatggtttctaaggagttgcggaatgtgctgctgaataacagtgagaagatgaaggttattaacacggggatcaaagtctggtgtagaaataacagcggtgaagagtttgactgtgctttccggctggcacaggagggaatatatacattgtatccatttattaactcaagaattattactgtatcaatggaagatgttaagatactgttgacccaggaaaatcccttttttagaaaactcagcagtgagacctacagtcaagcaaaggacctggcaaagggaagcatcgtgctgaagtatgaaccagattctgcgaatccagacgctctgcagtgtcccatcgtcttatgcggatggcggggaaaggcctccattcgaacttttgtgcccaagaatgaacggcttcattatctcaggatgatggggctggaggtattgggagaaaagaagaaggaaggggttatcctcacaaatgagagtgcagccagcaccggacagccagacaatgacgtgactgagggacagagagcaggagagcccaacagcccagatgcagaagaggccaacagtccagacgtgacagcaggctgtgacccggcgggggtccatccaccccggtgagcaggcccaaggcagcgggggcccacacccctcacacgcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtcttaaggtgcagtattttttaaattattatttatagaaagaatctataaattcttggggaagtgtgttataagctttaataattacattgagctgcacctcagtggtgtgtcattaacatgcagtggggttaatatctgaggcctcagatgactttgtgccttttggaataaagggtaaaataaactctcccagagtaagagctgtatcgtgaattgtcatactaattattgagggggacttatgtgcttttattgaatggagtgctttacaatttttatttttaaatggggttgggatccttggaatatttcaataaaattgataaaata

SEQ ID NO: 345028 - DNA, 4111 bp, Homo sapiens
  misc_feature (708)..(708): n is a, c, g, or t
  misc_feature (946)..(946): n is a, c, g, or t
acagcaggctgtttctcagatcttctcctgacctcctttcacctgctgctttttctccccaaggcaggccatagaaactaaaagtataatcttcctttgcccgtcttccagttggccataaaaagaatcctctgacctaccttgtctgattttaggtcatgagacccccatttcagaagggattctgccccatacctgagaggaagaaatgtagacaggccttgttggacttccccactccatctgtattagattatgcctcttttgtccaatcccatttctccagtgttgtccatgcttcaatcatccctatccaatgaggtctccataaaaggcccaagaagacaggtttagagagctttcggagaacagaacacttggctttgcaaagtggcacgcctggagagaacttggaagctccacgccccttctatacctcaccctatgcatctcttcagctgtatcttttgtgatatcctttataataaaccagtaaacggacctaagtgttcctctgagttctgcaagctgctccagcaaattaaaaagaaggggtgtgagccaccacgcccggctgcagatggtgtttctttatcaagcctacttacagaagatagatttcactgtttgaatttttagtaacaatttcccctttcccccacctttgttcattattattactattattattattattattacttactnccttacatgaagggtagtagtgtgtagttaaaagctaccatcagactccctgggttcaaatcctaatcggcaagttacttacagtgttagacatcccatgtgaaatgggacgaatcagtatgtagcttgcgaggtgctcaggaaatgttagctgttatagtgacaccacgcccctttctcttaagtggaaacaaatacccatcgtgatgttttagagtcagctttcatctcgtcctanctttgttcaggcaaacttctctagttctgttttaataggcatatttgttaggtctgttttttgaaatcctcttttttacattgtttaaagataatgccttggctaaaaagcctgcttcacttttccctgtttttagttgttttctccacattggcagtaaagagccttggcgtcccagcagcagcaggttctcctttttgtattgtggatgttttgcatttcatactgttgtgaagagtggctttgatcatacatgttgttggtatatttgcctttttgctgggggtgtgagaagaaccagagatgagcagaggtacacccagtagacttcccagcctgcagagcctcccgggaagagcttccgtgttcaggtgcttggggccccaccctaggagcctgactcacagtcagagcagggtcccggcttgtgttcaggattttgaaacatttgtaaggtgattttgttgtttctacacctttctcctcatcttttttttttgtagttaatcgttactaataacagaaaagacatttttggcatggtaattggcacaaagtgaataattgttgaatagatgacttttgaggctttcaaaattcgagtgtccataaaatccatccagagccacctggttcctttttttgaaccacttaacgtaattctggaaaaccttgactgtgggtcttaagtttggtggattgctgcttctcactggctgacctttggaggtcgcatatttcaggatgtgactccacttaggctccatttcacctgacactgcaattctgtgccttcagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatcgaattttatgtgatgtcccttgcagtggagacggcactatgagaaaaaacattgatgtttggaaaaagtggaccaccttaaatagcttgcagctacatggcttacagctgcggattgcaacacgcggggctgaacagctggctgaaggtggaaggatggtgtattccacgtgttcactaaaccctattgaggatgaagcagtcatagcatctttactggaaaaaagtgaaggtgctttggagcttgctgatgtgtctaatgaactgccagggctgaagtggatgcctggaatcacacagtggaaggtaatgacgaaagatgggcagtggtttacagactgggacgctgttcctcacagcagacacacccagatccgacctaccatgttccctccgaaggacccagaaaagctgcaggccatgcacctggagcgatgccttaggatattaccccatcatcagaatactggagggttttttgtggcagtattggtgaaaaaatcttcaatgccgtggaataaacgtcagccaaagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtggtcctcctccatcaaagaaaatgaagttatttggatttaaagaagatccatttgtatttattcctgaagatgacccattatttccacctattgagaaattttatgctttggatccttcattcccaaggatgaatttgttaactcggactacagaagggaagaaaaggcagctctacatggtttctaaggagttgcggaatgtgctgctgaataacagtgagaagatgaaggttattaacacggggatcaaagtctggtgtagaaataacagcggtgaagagtttgactgtgctttccggctggcacaggagggaatatatacattgtatccatttattaactcaagaattattactgtatcaatggaagatgttaagatactgttgacccaggaaaatcccttttttagaaaactcagcagtgagacctacagtcaagcaaaggacctggcaaagggaagcatcgtgctgaagtatgaaccagattctgcgaatccagacgctctgcagtgtcccatcgtcttatgcggatggcggggaaaggcctccattcgaacttttgtgcccaagaatgaacggcttcattatctcaggatgatggggctggaggtattgggagaaaagaagaaggaaggggttatcctcacaaatgagagtgcagccagcaccggacagccagacaatgacgtgactgagggacagagagcaggagagcccaacagcccagatgcagaagaggccaacagtccagacgtgacagcaggctgtgacccggcgggggtccatccaccccggtgagcaggcccaaggcagcgggggcccacacccctcacacgcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtcttaaggtgcagtattttttaaattattatttatagaaagaatctataaattcttggggaagtgtgttataagctttaataattacattgagctgcacctcagtggtgtgtcattaacatgcagtggggttaatatctgaggcctcagatgactttgtgccttttggaataaagggtaaaataaactctcccagagtaagagctgtatcgtgaattgtcatactaattattgagggggacttatgtgcttttattgaatggagtgctttacaatttttatttttaaatggggttgggatccttggaatatttcaataaaattgataaaata

SEQ ID NO: 345029 - DNA, 1105 bp, Homo sapiens
cagaagaggccgacagtccatccgaagcagggaaaactcagcagtgagacctacagtcaagcaaaggacctggcaaagggaagcatcgtgctgaagtatgaaccagattctgcgaatccagacgctctgcagtgtcccatcgtcttatgcggatggcggggaaaggcctccattcgaacttttgtgcccaagaatgaacggcttcattatctcaggatgatggggctggaggtattgggagaaaagaagaaggaaggggttatcctcacaaatgagagtgcagccagcaccggacagccagacaatgacgtgactgagggacagagagcaggagagcccaacagcccagatgcagaagaggccaacagtccagacgtgacagcaggctgtgacccggcgggggtccatccaccccggtgagcaggcccaaggcagcgggggcccacacccctcacacgcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtcttaaggtgcagtattttttaaattattatttatagaaagaatctataaattcttggggaagtgtgttataagctttaataattacattgagctgcacctcagtggtgtgtcattaacatgcagtggggttaatatctgaggcctcagatgactttgtgccttttggaataaagggtaaaataaactctcccagagtaagagctgtatcgtgaattgtcatactaattattgagggggacttatgtgcttttattgaatggagtgctttacaatttttatttttaaatggggttgggatccttggaatatttcaataaaattgataaaata

SEQ ID NO: 345030 - DNA, 1077 bp, Homo sapiens
cacccccacaacccacccacaacctccgcccacaccgaccaattcgcaaaggcagcatcgcgcttttaattgagccacattctgcgaatccagacgctctgcagtgtcccatcgtcttatgcggatggcggggaaaggcctccattcgaacttttgtgcccaagaatgaacggcttcattatctcaggatgatggggctggaggtattgggagaaaagaagaaggaaggggttatcctcacaaatgagagtgcagccagcaccggacagccagacaatgacgtgactgagggacagagagcaggagagcccaacagcccagatgcagaagaggccaacagtccagacgtgacagcaggctgtgacccggcgggggtccatccaccccggtgagcaggcccaaggcagcgggggcccacacccctcacacgcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtcttaaggtgcagtattttttaaattattatttatagaaagaatctataaattcttggggaagtgtgttataagctttaataattacattgagctgcacctcagtggtgtgtcattaacatgcagtggggttaatatctgaggcctcagatgactttgtgccttttggaataaagggtaaaataaactctcccagagtaagagctgtatcgtgaattgtcatactaattattgagggggacttatgtgcttttattgaatggagtgctttacaatttttatttttaaatggggttgggatccttggaatatttcaataaaattgataaaata

SEQ ID NO: 345031 - DNA, 2546 bp, Homo sapiens
tgcttcctggagcatttttttccccttagagctgttcgctgttttccctgtcacgccgcttttctgaaagacgggttgtgcgctttgggcttattcctggacggtccccaaaggtccccgaaaggaccaggcccggacacgtggggccttggtttccggccggaagtcccgggaggtgtagggctagagttctggccgtggcgggccggtttctgcgtgctgcgtgcgcggccgcgtgggctatggggcggcggtcgcggggtcggcggctccagcaacagcagcggccggaggacgcggaggatggcgccgagggtggtggaaagcgcggcgaggcgggctgggaaggaggctaccccgagatcgtcaaggagaacaagctgttcgagcactactaccaggagctcaagatcgtgcccgagggcgagtggggccagttcatggacgctctcagggagccgctcccggccactttaagaattactggttacaaaagccacgcaaaagagattctccattgcttaaagaacaaatattttaaggaattggaggacctggaggtggacggtcagaaagttgaagttccacagccactgagttggtatcctgaagaacttgcctggcacacaaatttaagtcgaaaaatcttgagaaaatcgccacacttggaaaagtttcatcagtttctagttagtgaaacagaatctggaaatattagtcgtcaagaagctgttagcatgatcccaccactgctcctcaacgtgcggcctcatcataagatcttagatatgtgtgcagcacctggctcaaagaccacacagttaattgaaatgctacatgccgacatgaatgtcccctttccagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatcgaattttatgtgatgtcccttgcagtggagacggcactatgagaaaaaacattgatgtttggaaaaagtggaccaccttaaatagcttgcagctacatggcttacagctgcggattgcaacacgcggggctgaacagctggctgaaggtggaaggatggtgtattccacgtgttcactaaaccctattgaggatgaagcagtcatagcatctttactggaaaaaagtgaaggtgctttggagcttgctgatgtgtctaatgaactgccagggctgaagtggatgcctggaatcacacagtggaaggtaatgacgaaagatgggcagtggtttacagactgggacgctgttcctcacagcagacacacccagatccgacctaccatgttccctccgaaggacccagaaaagctgcaggccatgcacctggagcgatgccttaggatattaccccatcatcagaatactggagggttttttgtggcagtattggtgaaaaaatcttcaatgccgtggaataaacgtcagccaaagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtggtcctcctccatcaaagaaaatgaagttatttggatttaaagaagatccatttgtatttattcctgaagatgacccattatttccacctattgagaaattttatgctttggatccttcattcccaaggatgaatttgttaactcggactacagaagggaagaaaaggcagctctacatggtttctaaggagttgcggaatgtgctgctgaataacagtgagaagatgaaggttattaacacggggatcaaagtctggtgtagaaataacagcggtgaagagtttgactgtgctttccggctggcacaggagggaatatatacattgtatccatttattaactcaagaattattactgtatcaatggaagatgttaagatactgttgacccaggaaaatcccttttttagaaaactcagcagtgagacctacagtcaagcaaaggacctggcaaagggaagcatcgtgctgaagtatgaaccagattctgcgtaagtcagtacacgccctgcccttagacgcacacgccttgtcattagctacagtgttctcgttggtgaggaaagtgacttgggaaggtgggaaccttcttcaggccttttgtgattgttcctcagaagtagccttgtgaaaacttcagaaccaaaatattcctgtaggtcatcatgaagatgctgtttcatagaacactcagctcaggctaagtgaatttttacttacagagaataaaatgcatagtacttattttttaagcattagaaaccaatgaaaatttctgtcttgtacagagtaagtgtg

SEQ ID NO: 345032 - DNA, 1317 bp, Homo sapiens
tgcttcctggagcatttttttccccttagagctgttcgctgttttccctgtcacgccgcttttctgaaagacgggttgtgcgctttgggcttattcctggacggtccccaaaggtccccgaaaggaccaggcccggacacgtggggccttggtttccggccggaagtcccgggaggtgtagggctagagttctggccgtggcgggccggtttctgcgtgctgcgtgcgcggccgcgtgggctatggggcggcggtcgcggggtcggcggctccagcaacagcagcggccggaggacgcggaggatggcgccgagggtggtggaaagcgcggcgaggcgggctgggaaggaggctaccccgagatcgtcaaggagaacaagctgttcgagcactactaccaggagctcaagatcgtgcccgagggcgagtggggccagttcatggacgctctcagggagccgctcccggccactttaagaattactggttacaaaagccacgcaaaagagattctccattgcttaaagaacaaatattttaaggaattggaggacctggaggtggacggtcagaaagttgaagttccacagccactgagttggtatcctgaagaacttgcctggcacacaaatttaagtcgaaaaatcttgagaaaatcgccacacttggaaaagtttcatcagtttctagttagtgaaacagaatctggaaatattagtcgtcaagaagctgttagcatgatcccaccactgctcctcaacgtgcggcctcatcataagatcttagatatgtgtgcagcacctggctcaaagaccacacagttaattgaaatgctacatgccgacatgaatgtcccctttccagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatcgaattttatgtgatgtcccttgcagtggagacggcactatgagaaaaaacattgatgtttggaaaaagtggaccaccttaaatagcttgcagctacatggcttacagctgcggattgcaacacgcggggctgaacagctggctgaaggtggaaggatggtgtattccacgtgttcactaaaccctattgaggatgaagcagtcatagcatctttactggaaaaaagtgaagtgtgataaaggatgctcgttgatgattacctaatgaatcttccagggctgaaag

SEQ ID NO: 345033 - DNA, 582 bp, Homo sapiens
aacgtggtatttttaacttttcgtagcagcacaaagaatgctcctctttgtgtgtcaatgaaattgttctttatgacagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtgggtaagaaaagtggttatgtcttgatctaatacgctggtgtcttcacagtccttttggattaaatgggatcccagagccacttcttggtcggtttgagggggcagtacatgtgtggtatcaggcacatgcagtgtgagggctggactctgtggaagccggaaggtttcaacatctgccgcaaaccgttccatgttgcacagaactgacagaaaggaagaatgtgcttttggtattgaaggttaccacacattacagattgatttgtctcatcctgattccctttttagtcctcctccatcaaagaaaatgaagttattt

SEQ ID NO: 345034 - DNA, 401 bp, Homo sapiens
tctcagggagccgctcccggccactttaagaattactggttacaaaaggtagggaggcagtgcctgattttttgggagttggggccaggatgctggaggttaaaggcgacggtgttttcttcgacaagtgttacagtgccagagaaccgtggcgtttcagcggtttggattcaggaagcattgaggtggggagcacagggtccaatgaaatggtcacggaggtattgcaggcgcaaggttagaagacgaaatgaaaatgagatctgaggaagattcggctcctggggaatcttccaggagggaagctgagggtcttaccttttggaacgtaagagaatttatagagaatgcataaaaccccttggttctcccctcctccgcgccccccctccatctttgta

SEQ ID NO: 345035 - DNA, 4184 bp, Homo sapiens
  misc_feature (708)..(708): n is a, c, g, or t
  misc_feature (946)..(946): n is a, c, g, or t
acagcaggctgtttctcagatcttctcctgacctcctttcacctgctgctttttctccccaaggcaggccatagaaactaaaagtataatcttcctttgcccgtcttccagttggccataaaaagaatcctctgacctaccttgtctgattttaggtcatgagacccccatttcagaagggattctgccccatacctgagaggaagaaatgtagacaggccttgttggacttccccactccatctgtattagattatgcctcttttgtccaatcccatttctccagtgttgtccatgcttcaatcatccctatccaatgaggtctccataaaaggcccaagaagacaggtttagagagctttcggagaacagaacacttggctttgcaaagtggcacgcctggagagaacttggaagctccacgccccttctatacctcaccctatgcatctcttcagctgtatcttttgtgatatcctttataataaaccagtaaacggacctaagtgttcctctgagttctgcaagctgctccagcaaattaaaaagaaggggtgtgagccaccacgcccggctgcagatggtgtttctttatcaagcctacttacagaagatagatttcactgtttgaatttttagtaacaatttcccctttcccccacctttgttcattattattactattattattattattattacttactnccttacatgaagggtagtagtgtgtagttaaaagctaccatcagactccctgggttcaaatcctaatcggcaagttacttacagtgttagacatcccatgtgaaatgggacgaatcagtatgtagcttgcgaggtgctcaggaaatgttagctgttatagtgacaccacgcccctttctcttaagtggaaacaaatacccatcgtgatgttttagagtcagctttcatctcgtcctanctttgttcaggcaaacttctctagttctgttttaataggcatatttgttaggtctgttttttgaaatcctcttttttacattgtttaaagataatgccttggctaaaaagcctgcttcacttttccctgtttttagttgttttctccacattggcagtaaagagccttggcgtcccagcagcagcaggttctcctttttgtattgtggatgttttgcatttcatactgttgtgaagagtggctttgatcatacatgttgttggtatatttgcctttttgctgggggtgtgagaagaaccagagatgagcagaggtacacccagtagacttcccagcctgcagagcctcccgggaagagcttccgtgttcaggtgcttggggccccaccctaggagcctgactcacagtcagagcagggtcccggcttgtgttcaggattttgaaacatttgtaaggtgattttgttgtttctacacctttctcctcatcttttttttttgtagttaatcgttactaataacagaaaagacatttttggcatggtaattggcacaaagtgaataattgttgaatagatgacttttgaggctttcaaaattcgagtgtccataaaatccatccagagccacctggttcctttttttgaaccacttaacgtaattctggaaaaccttgactgtgggtcttaagtttggtggattgctgcttctcactggctgacctttggaggtcgcatatttcaggatgtgactccacttaggctccatttcacctgacactgcaattctgtgccttcagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatcgaattttatgtgatgtcccttgcagtggagacggcactatgagaaaaaacattgatgtttggaaaaagtggaccaccttaaatagcttgcagctacatggcttacagctgcggattgcaacacgcggggctgaacagctggctgaaggtggaaggatggtgtattccacgtgttcactaaaccctattgaggatgaagcagtcatagcatctttactggaaaaaagtgaaggtgctttggagcttgctgatgtgtctaatgaactgccagggctgaagtggatgcctggaatcacacagtggaaggtaatgacgaaagatgggcagtggtttacagactgggacgctgttcctcacagcagacacacccagatccgacctaccatgttccctccgaaggacccagaaaagctgcaggccatgcacctggagcgatgccttaggatattaccccatcatcagaatactggagggttttttgtggcagtattggtgaaaaaatcttcaatgccgtggaataaacgtcagccaaagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtggtcctcctccatcaaagaaaatgaagttatttggatttaaagaagatccatttgtatttattcctgaagatgacccattatttccacctattgagaaattttatgctttggatccttcattcccaaggatgaatttgttaactcggactacagaagggaagaaaaggcagctctacatggtttctaaggagttgcggaatgtgctgctgaataacagtgagaagatgaaggttattaacacggggatcaaagtctggtgtagaaataacagcggtgaagagtttgactgtgctttccggctggcacaggagggaatatatacattgtatccatttattaactcaagaattattactgtatcaatggaagatgttaagatactgttgacccaggaaaatcccttttttagaaaactcagcagtgagacctacagtcaagcaaaggacctggcaaagggaagcatcgtgctgaagtatgaaccagattctgcgaatccagacgctctgcagtgtcccatcgtcttatgcggatggcggggaaaggcctccattcgaacttttgtgcccaagaatgaacggcttcattatctcaggatgatggggctggaggtattgggagaaaagaagaaggaaggggttatcctcacaaatgagagtgcagccagcaccggacagccagacaatgacgtgactgagggacagagagcaggagagcccaacagcccagatgcagaagaggccaacagtccagacgtgacagcaggctgtgacccggcgggggtccatccaccccggtgagcaggcccaaggcagcgggggcccacacccctcacacgcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtcttaaggtgcagtattttttaaattattatttatagaaagaatctataaattcttggggaagtgtgttataagctttaataattacattgagctgcacctcagtggtgtgtcattaacatgcagtggggttaatatctgaggcctcagatgactttgtgccttttggaataaagggtaaaataaactctcccagagtaagagctgtatcgtgaattgtcatactaattattgagggggacttatgtgcttttattgaatggagtgctttacaatttttatttttaaatggggttgggatccttggaatatttcaataaaattgataaaataccaaaacacacaagaacaaaacacacacaaaaacattttgaagccccctcgcccccgaaaaactcttagaaca

SEQ ID NO: 345036 - DNA, 3126 bp, Homo sapiens
tgcttcctggagcatttttttccccttagagctgttcgctgttttccctgtcacgccgcttttctgaaagacgggttgtgcgctttgggcttattcctggacggtccccaaaggtccccgaaaggaccaggcccggacacgtggggccttggtttccggccggaagtcccgggaggtgtagggctagagttctggccgtggcgggccggtttctgcgtgctgcgtgcgcggccgcgtgggctatggggcggcggtcgcggggtcggcggctccagcaacagcagcggccggaggacgcggaggatggcgccgagggtggtggaaagcgcggcgaggcgggctgggaaggaggctaccccgagatcgtcaaggagaacaagctgttcgagcactactaccaggagctcaagatcgtgcccgagggcgagtggggccagttcatggacgctctcagggagccgctcccggccactttaagaattactggttacaaaaggtatcctgaagaacttgcctggcacacaaatttaagtcgaaaaatcttgagaaaatcgccacacttggaaaagtttcatcagtttctagttagtgaaacagaatctggaaatattagtcgtcaagaagctgttagcatgatcccaccactgctcctcaacgtgcggcctcatcataagatcttagatatgtgtgcagcacctggctcaaagaccacacagttaattgaaatgctacatgccgacatgaatgtcccctttccagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatcgaattttatgtgatgtcccttgcagtggagacggcactatgagaaaaaacattgatgtttggaaaaagtggaccaccttaaatagcttgcagctacatggcttacagctgcggattgcaacacgcggggctgaacagctggctgaaggtggaaggatggtgtattccacgtgttcactaaaccctattgaggatgaagcagtcatagcatctttactggaaaaaagtgaaggtgctttggagcttgctgatgtgtctaatgaactgccagggctgaagtggatgcctggaatcacacagtggaaggtaatgacgaaagatgggcagtggtttacagactgggacgctgttcctcacagcagacacacccagatccgacctaccatgttccctccgaaggacccagaaaagctgcaggccatgcacctggagcgatgccttaggatattaccccatcatcagaatactggagggttttttgtggcagtattggtgaaaaaatcttcaatgccgtggaataaacgtcagccaaagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtggtcctcctccatcaaagaaaatgaagttatttggatttaaagaagatccatttgtatttattcctgaagatgacccattatttccacctattgagaaattttatgctttggatccttcattcccaaggatgaatttgttaactcggactacagaagggaagaaaaggcagctctacatggtttctaaggagttgcggaatgtgctgctgaataacagtgagaagatgaaggttattaacacggggatcaaagtctggtgtagaaataacagcggtgaagagtttgactgtgctttccggctggcacaggagggaatatatacattgtatccatttattaactcaagaattattactgtatcaatggaagatgttaagatactgttgacccaggaaaatcccttttttagaaaactcagcagtgagacctacagtcaagcaaaggacctggcaaagggaagcatcgtgctgaagtatgaaccagattctgcgaatccagacgctctgcagtgtcccatcgtcttatgcggatggcggggaaaggcctccattcgaacttttgtgcccaagaatgaacggcttcattatctcaggatgatggggctggaggtattgggagaaaagaagaaggaaggggttatcctcacaaatgagagtgcagccagcaccggacagccagacaatgacgtgactgagggacagagagcaggagagcccaacagcccagatgcagaagaggccaacagtccagacgtgacagcaggctgtgacccggcgggggtccatccaccccggtgagcaggcccaaggcagcgggggcccacacccctcacacgcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtcttaaggtgcagtattttttaaattattatttatagaaagaatctataaattcttggggaagtgtgttataagctttaataattacattgagctgcacctcagtggtgtgtcattaacatgcagtggggttaatatctgaggcctcagatgactttgtgccttttggaataaagggtaaaataaactctcccagagtaagagctgtatcgtgaattgtcatactaattattgagggggacttatgtgcttttattgaatggagtgctttacaatttttatttttaaatggggttgggatccttggaatatttcaataaaattgataaaata

SEQ ID NO: 345037 - DNA, 3041 bp, Homo sapiens
tgcttcctggagcatttttttccccttagagctgttcgctgttttccctgtcacgccgcttttctgaaagacgggttgtgcgctttgggcttattcctggacggtccccaaaggtccccgaaaggaccaggcccggacacgtggggccttggtttccggccggaagtcccgggaggtgtagggctagagttctggccgtggcgggccggtttctgcgtgctgcgtgcgcggccgcgtgggctatggggcggcggtcgcggggtcggcggctccagcaacagcagcggccggaggacgcggaggatggcgccgagggtggtggaaagcgcggcgaggcgggctgggaaggaggctaccccgagatcgtcaaggagaacaagctgttcgagcactactaccaggagctcaagatcgtgcccgagggcgagtggggccagttcatggacgctctcagggagccgctcccggccactttaagaattactggttacaaaaggtatcctgaagaacttgcctggcacacaaatttaagtcgaaaaatcttgagaaaatcgccacacttggaaaagtttcatcagtttctagttagtgaaacagaatctggaaatattagtcgtcaagaagctgttagcatgatcccaccactgctcctcaacgtgcggcctcatcataagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatcgaattttatgtgatgtcccttgcagtggagacggcactatgagaaaaaacattgatgtttggaaaaagtggaccaccttaaatagcttgcagctacatggcttacagctgcggattgcaacacgcggggctgaacagctggctgaaggtggaaggatggtgtattccacgtgttcactaaaccctattgaggatgaagcagtcatagcatctttactggaaaaaagtgaaggtgctttggagcttgctgatgtgtctaatgaactgccagggctgaagtggatgcctggaatcacacagtggaaggtaatgacgaaagatgggcagtggtttacagactgggacgctgttcctcacagcagacacacccagatccgacctaccatgttccctccgaaggacccagaaaagctgcaggccatgcacctggagcgatgccttaggatattaccccatcatcagaatactggagggttttttgtggcagtattggtgaaaaaatcttcaatgccgtggaataaacgtcagccaaagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtggtcctcctccatcaaagaaaatgaagttatttggatttaaagaagatccatttgtatttattcctgaagatgacccattatttccacctattgagaaattttatgctttggatccttcattcccaaggatgaatttgttaactcggactacagaagggaagaaaaggcagctctacatggtttctaaggagttgcggaatgtgctgctgaataacagtgagaagatgaaggttattaacacggggatcaaagtctggtgtagaaataacagcggtgaagagtttgactgtgctttccggctggcacaggagggaatatatacattgtatccatttattaactcaagaattattactgtatcaatggaagatgttaagatactgttgacccaggaaaatcccttttttagaaaactcagcagtgagacctacagtcaagcaaaggacctggcaaagggaagcatcgtgctgaagtatgaaccagattctgcgaatccagacgctctgcagtgtcccatcgtcttatgcggatggcggggaaaggcctccattcgaacttttgtgcccaagaatgaacggcttcattatctcaggatgatggggctggaggtattgggagaaaagaagaaggaaggggttatcctcacaaatgagagtgcagccagcaccggacagccagacaatgacgtgactgagggacagagagcaggagagcccaacagcccagatgcagaagaggccaacagtccagacgtgacagcaggctgtgacccggcgggggtccatccaccccggtgagcaggcccaaggcagcgggggcccacacccctcacacgcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtcttaaggtgcagtattttttaaattattatttatagaaagaatctataaattcttggggaagtgtgttataagctttaataattacattgagctgcacctcagtggtgtgtcattaacatgcagtggggttaatatctgaggcctcagatgactttgtgccttttggaataaagggtaaaataaactctcccagagtaagagctgtatcgtgaattgtcatactaattattgagggggacttatgtgcttttattgaatggagtgctttacaatttttatttttaaatggggttgggatccttggaatatttcaataaaattgataaaata

SEQ ID NO: 345038 - DNA, 1704 bp, Homo sapiens
tgcttcctggagcatttttttccccttagagctgttcgctgttttccctgtcacgccgcttttctgaaagacgggttgtgcgctttgggcttattcctggacggtccccaaaggtccccgaaaggaccaggcccggacacgtggggccttggtttccggccggaagtcccgggaggtgtagggctagagttctggccgtggcgggccggtttctgcgtgctgcgtgcgcggccgcgtgggctatggggcggcggtcgcggggtcggcggctccagcaacagcagcggccggaggacgcggaggatggcgccgagggtggtggaaagcgcggcgaggcgggctgggaaggaggctaccccgagatcgtcaaggagaacaagctgttcgagcactactaccaggagctcaagatcgtgcccgagggcgagtggggccagttcatggacgctctcagggagccgctcccggccactttaagaattactggttacaaaagccacgcaaaagagattctccattgcttaaagaacaaatattttaaggaattggaggacctggaggtggacggtcagaaagttgaagttccacagccactgagttggtatcctgaagaacttgcctggcacacaaatttaagtcgaaaaatcttgagaaaatcgccacacttggaaaagtttcatcagtttctagttagtgaaacagaatctggaaatattagtcgtcaagaagctgttagcatgatcccaccactgctcctcaacgtgcggcctcatcataagatcttagatatgtgtgcagcacctggctcaaagaccacacagttaattgaaatgctacatgccgacatgaatgtcccctttccagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatcgaattttatgtgatgtcccttgcagtggagacggcactatgagaaaaaacattgatgtttggaaaaagtggaccaccttaaatagcttgcagctacatggcttacagctgcggattgcaacacgcggggctgaacagctggctgaaggtggaaggatggtgtattccacgtgttcactaaaccctattgaggatgaagcagtcatagcatctttactggaaaaaagtgaaggtgctttggagcttgctgatgtgtctaatgaactgccagggctgaagtggatgcctggaatcacacagtggaaggtaatgacgaaagatgggcagtggtttacagactgggacgctgttcctcacagcagacacacccagatccgacctaccatgttccctccgaaggacccagaaaagctgcaggccatgcacctggagcgatgccttaggatattaccccatcatcagaatactggagggttttttgtggcagtattggtgaaaaaatcttcaatgccgtggaataaacgtcagccaaaggtgagtttttctttttccaaaatgacataacatttgatcttgtacatttaagacaaaaactaaccggagtttagtagaagtacagaggaaagaggagcttcttgctgtgggcagcaggagagctgaccctgaatgaggg

SEQ ID NO: 345039 - DNA, 219 bp, Homo sapiens
tgagttcttttcagaccatatttagatgtgcagtctacatttaatgtgtttttaaaaatagcattcttatccaaaatatgtgtttttggccagatttttgtcagtttaccttgtatgttttctgtgatagtttagagaaagggagtggtcttcagttcagaggtgatacagtattcagatggaatgttcactcttgccctttagggaaggtttcaaggt

SEQ ID NO: 345040 - DNA, 113 bp, Homo sapiens
ggtcgaagaggcaaacaagtttccttgggccccccttataacaataccaattccattcatcatgggtctgccctcataacccaattacctcccaaaagccataccttccaaca

SEQ ID NO: 345041 - DNA, 629 bp, Homo sapiens
tcttgttttgctaatcttctctgtatcatcccagttttagtatatgtgctgtcaaagcaggcacacaatatggtaaatattagtagatggaacccaatatccaaaaaagcccattgggtctcttttttctttttgagatggggtcacccaggctagagtacaatggcatgatcgggctcactgcaacctcttcacccccaggctcaagtggtccttctcatgagtggctgggactacagatgtgagccaccacacctggctaatttttctgtagtgatggggtttcaccacgttgtccaggctgggcttgaactcctgggctcaagcgatctgcccgcctcagcctcccagagtgtcaggattacagatggaagccaccacacccggcttgtttgggtctcaataattatgagtacacaggggtcctgagaccaactgatttgataactactgaactgccgtacagcaagacctcaagctcagaaataactcaggcgctaatgaaagttaaaggaaatatccctttcctccttttctctgaacttaatgccctagaattgtgtgaggtatcaacagaaaaaactttaatcatcatagcagagcctagtacagctataatccaaatttct

SEQ ID NO: 345042 - DNA, 368 bp, Homo sapiens
tttttcagctcccattttgtgtccagtactgcgttgagtcctggggattcaaagattccgttcttcttgtttgggtagctgagacctatcagaagtgcttcaggggccagctcagtttcctgatacgaaaaaagtatgcaagagtggatagaccagagtgctccagtggcccccatggttctcaagctctgattctaggtaaggctctgctggaaggaattgccagatgcaagccctagatgctgctgaatgcactgaagcccaggggcccagcaacccagtagccagccagcacctgccagactctgactcctctgtagattaattgcaaatcacggagaatatcacaaaataaatcacacaataaa

SEQ ID NO: 345043 - DNA, 679 bp, Homo sapiens
cgcgatcttggcacactgcaacctccacctccccggttcaagtgattctccttcctcagcctcctgagtagctgggattacaggcatgcaccaccacgccaggctaattttgtatttttagtagagatggagtctcaccatgttggtcagactggtctcgaactcccgacctcaggtgaactgcctgccttcgcctcccaaagtgctgggattacaggcgtgagccgctgcgcccggccgagaggcacacattctgctaagagctttttcctgactcccctaactccaagagggatttgtcactccttagctttgtactcatgactggagtagaatgaatttaatttgagtttagttgtttttgagactctccctggctagtgtagtgtcttattcgtctttgttgtgatcatggcctgcacctaacagatgatcagtagatgtttgcagacagaaagtaaaccactcatcaggtgtattcagtcccattcttgaacgggcttgctgcctcctttttgaggagatttgtgtatgtactcttctttcacgcatatgtgtgagcaaacacacacacactaacaaggaattcatctgaagatgtgcacaggaaatatcttgcatctttaccccctttgtgatcttacatatgggagaactgaggcacagaaataagttagga

SEQ ID NO: 345044 - DNA, 246 bp, Homo sapiens
acagtcaatcccagaagcagacagattcacttctcccagcacccaatggacccccaaatcactggtcaacatccccttcccactgctgcagcaatcataaaaacagtcaatcccagaagcagacagattcacttctcccagcacccaatggacccccaaatcactggtcaacatccccttcccactgctgcagcaatcataaaaacagtcaatcccagaagcagacaggttcacttctcccagcac

SEQ ID NO: 345045 - DNA, 388 bp, Homo sapiens
ctatttttattgaattcttaactatttttattgaatcatcagatctgtaaaattttaagtgagagctattgaacctgtattaagatagaaaactcttaagataagaattttaaatgacgagattcatttaggcagctggctgccaattctctgaattcacttcaagacaaagtttcttcttcatatataaatatacataggcatataaattattctatattatggtggtaaaacttaatgctgactttggatgttcagattcaggaaatgatcttagaattatgaactttgtatttttaaactatttggtgcagcatttcattttgggtcacatgtaagcagatattgatatgtcatttttaatctaataaagttggtgatcagagca

SEQ ID NO: 345046 - DNA, 492 bp, Homo sapiens
  misc_feature (44)..(45): n is a, c, g, or t
attcgcggccgcgtcgaccaatgatgatgctacaaagatttttnntgtgctgaaaatctttgtagcatcatcattgctctaaagaaaagctagaagcctgccataatgattagcaaactcatatagatatctccaggaaaggatttacaaaatgtcatcacatccttgtaatcatctaattatcaaactcagcagtgttgacaaagcacaagcccactcagctactgctaatgattattattcaaagctacatttctaccaaatcagaataacttacaggtagaagctcattagccttaggaaccaccctccttgaacactcacacgcacacgcacacgcgtgacacgcatacacacacgcgcacgcgcgcacacacacgcacacacaccccagccataactaggccttgctgaattgtcatttgctttcatgaccctccttcgtgtatatgagcagctttacgaattggttcaaaaatacccagcctttca

SEQ ID NO: 345047 - DNA, 757 bp, Homo sapiens
cattggcatcttggctgcaggtcattacgataatgagagctaggggtaaccatgtccatcagagggctgggacgtaagcatttgtgtgaaaaggctagctgttgttgatcttttacatttccgcaaggtatgacagaacaagcattcaaggcggtggtctgaggtgagttagttacagtaataacaaaggcgctagtaacaataaggaaaggaagcaatatgaaggtacaggaaaattaagctttctttaactttaacttagtaggattggtcctagtacagtcatccatgattctgagagaaagatgttttcttgactggagtgtggtcgtttttttcttggctctgcggatggcagtctcagtggttaacagcataaaatagggttcttcccaggctggctcaagttttttctttctgtcttttgatgaggacgtggttttcaggctggtgctggtgtactggaaattctaggggtggtacctagaactaaaagtcttttagttctgagggaagggaaactggaagataaattaagtatatcatttttgctgcatatcctggggcttgaggccccatggtgatgcctcccgctccattcctgctcagcgccgcccaggggacactgcggccctgcctcctcttaagctcttggccttcttggggccttcactgcccctgtgcactgtggccttggacatgaggggccttgtgacttacctggccaccttcaggccttaagaaagctaaacaccat

SEQ ID NO: 345048 - DNA, 1038 bp, Homo sapiens
ggaataatgccacaggtggacttcaacaaacaaacaaagagcacaactgtcaagaacagaagttcatggatgggagagttacaaaagttggtggcatgacttcccctttctgaaattctaatcccgaagagtacaaagcaactgcgcagccaaaaagctgtgcagcagtggcctgggaagggctcgacgaagggcatagctcaggggcactgctcaggggcagagctctggggcatcgcccactcatagggagagcagcagggagccacacttcccatcccaactcagcttctgtcccagctctcatcccaggctccccagcccacaggatgatccctgtgaagagaagcatgtgaagatggaggaatcccaaccaagattccaccaaggacaaaaatagctaacacgatgagagacagaggccagggaaggttgtagaacatgtgcctctattgaccgtggcagacatttctcagcaaccccttacccctgccacttccctgactttgccatgtgaggatgcaggtccagggggccaaatcaaccagtttttcaagagaaaaaaaaacactgcagtgtttataactgtgtggaccaaagagaacatgtctacaggccagtgtgcagttcctatattagaagaggggtctgagttgatcctgcctattgcactgggtccagtatcttgttcaaggtctaacaaaggtaggtgctcaatacatatctgttaaatcagtgcatgagaaccaaatattagattaggcagcaaattgtaagccaatgtctttccttcctcctccattaaagaaacgctacagcttaagagaggtagatggagtagcaggttctaagtaaaaggaaatctacatataagttactcaccaagtcactattaacagtgccagggttagtgttattgccctccacatcgcaattcttcaagctcttcagttatgctgttatgtttacctcaatcccaatctaattcttttcatcctcttttcccttctcacgttttttaaagacctcacttgggga

SEQ ID NO: 345049 - DNA, 898 bp, Homo sapiens
cagatgcttggacgataccgagaatacagtaatggacaggcgggtgcgatagaacatttaaaagaaagcttggaacaatcaatcgaccaactccggagtcaacgtttattgagaaactcaggagggagaagtatttctgttacaagtttgagtgcaagtgaccttgatggtggcactgggtcagagctccatcattttccacctacctcacctctcaaggactatggggatccacagggtattaaacgaatgagatcaagaactggtgtccggtttgttcaagagactgatgatatgactcagcttcatggttttcatcagtctcttcgagacctcagcagtgaacaaattcgccttggagatgatttcaacagggagctttccagaaggagccggtcagatgccgaaacaaaaagggctttggaagaattgactgaaaaacttaatgaagcccagaaacaagaagtggtttcagatcgggtggagcggcggcttcaggaactggagagagagatgcgcacagaaagggagctggtggaaagacgccaggatcaactgggactcatgtccctgcagctacaggaggcactaaagaaacaagaagctaaagcagatgagcatgagggggcaataaaaaataagctaagacaaactgaaactgagaagaatcaacttgaacaggaattggagctatctcgaaggttattgaatcaatcagaaggcagccgagaaacacttttgcatcaggtagaagaactgcgtacacaacttacgaaagcagaaggtgatcgaaagggtttacagcatcaagtatctcagatttccaagcaacagtcaaactatcaggatgaacaaggggaggactggagatttaggagaggtaaaagtagatttgtac

SEQ ID NO: 345050 - DNA, 385 bp, Homo sapiens
atgagtaaagatgcctcacaaggtcgtttcagcccttgcctgtaaagttcaccaattcagtatttgaatcaatttagtatctcctttactatgtttctccttttaatctcagccaaccccctacctgcaggtaaacccagcattcattaagagctgggttggggtactctattctgtatgcatcataatagcttaacattatttagtagctgtaacttacaggtttaatgctagatgaggatgtctcaagccgtgagtgtgcttgtgtaaaaatggtggcaacatcatctcgttggtaggaattttttacttgaattgttattttgggaaaatgttaacagatttcttctggataaagaaaataaattggatgatgtatatttta

SEQ ID NO: 345051 - DNA, 3251 bp, Homo sapiens
ttgagtgcaggtactctatctaactcaattgtactctctttgctgccctctctgacacctggcatattgtttgatacatgataagctttcagtaaaggctgatgagcgatgaacagctattaacaaaagataggagataagaaaataaacattttcttagtcctttgagatgtcccaataaaacggtacttttgaaataactgtatatcttttattaattataattttatgtcatgccaatgttttggttaagagtctaagaaggctgcatttgcctctgaatcactctatggtcaaggccttgtattgtgagaacagcccaatcatattgacctggcacatgcttctctgaagtcacatgtccagcattgtgacatgagcaagaatgcaggcaacctcttgattccactcattcaaagttctctgtggggactaggttcagaagatgtcatctcccccatagactagcttcccagagaatgtcacctgcaaactagaatgatgctagtctcagcttaactgtgcaaagagaaaaccagaacgcgctccccaggaacaaggttcattcacagttgtcagaaggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggtcatagtaatgggagctaccaatcgtcctcaggaccttgactcggctataatgagaagaatgcctacaagatttcatatcaaccagcctgctttaaaacagagagaagcaatcctgaaactcatcttgaaaaatgaaaatgtggataggcatgtagacctgctagaagttgcccaggaaactgatgggttttcaggaagtgacctaaaagagatgtgtcgagatgctgccctcctctgtgttagagaatatgttaattctacatcagaagaaagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctcttta

SEQ ID NO: 345052 - DNA, 4011 bp, Homo sapiens
ctcccaggttgcgtttccttcctgtgtgaggccggctgagggcacttgctcttgctgtttctgcccctgggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggtcatagtaatgggagctaccaatcgtcctcaggaccttgactcggctataatgagaagaatgcctacaagatttcatatcaaccagcctgctttaaaacagagagaagcaatcctgaaactcatcttgaaaaatgaaaatgtggataggcatgtagacctgctagaagttgcccaggaaactgatgggttttcaggaagtgacctaaaagagatgtgtcgagatgctgccctcctctgtgttagagaatatgttaattctacatcagaagaaagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctctttattggttgttctccacttaatctttggtctttttcagtaattttaagttttctgggattttttttggtttataaaacttgtgtttagactttatcttgctatggagttttcacacttctataggcacatatcctagtatctagtcatttctgttttaatatgaatttcagtaatttaattttaatctggtgacatattaatcgaaaataaggagtaatgtatacctccacatgtcctttctttttgtcttctcttaaattcacaatatccagtaggagtggttattcaatttcttcgtggttttaatcatcaaatgaagttagagaagtatactaatcccagcaactatgactcatctaggcatgttaagaccataaagtaattcaggaaactattttcctgatttttaaataacttttagtgttatgtaacatctatccttctgttttagacatgcatttcacatatagttgaattctagattctaagataattcattttgggtaatacttcagagtactggatctagaatcaggcttcctgaatttaaactcaggctccccattaactgtgtgtctgtgagcccagtttctcatctgtaaaatggggcaacagtggcactcatcttaaagggttggataataaaataatgcatgtaaggccctcagcatagtgcctggcacagaattactgctcaaatgttagctgtcgtattaatattgtcacttttgcacactgatgtacatttcctgttgaccaggctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcaggccttttttgtagagtttagaaatgaagtatttgaatcaatttagtatctcctttactatgtttctccttttaatctcagccaaccccctacctgcaggtaaacccagcattcattaagagctgggttggggtactctattctgtatgcatcataatagcttaacattatttagtagctgtaacttacaggtttaatgctagatgaggatgtctcaagccgtgagtgtgcttgtgtaaaaatggtggcaacatcatctcgttggtaggaattttttacttgaattgttattttgggaaaatgttaacagatttcttctggataaagaaaataaattggatgatgtatatttta

SEQ ID NO: 345053 - DNA, 4841 bp, Homo sapiens
ctcccaggttgcgtttccttcctgtgtgaggccggctgagggcacttgctcttgctgtttctgcccctgggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggtcatagtaatgggagctaccaatcgtcctcaggaccttgactcggctataatgagaagaatgcctacaagatttcatatcaaccagcctgctttaaaacagagagaagcaatcctgaaactcatcttgaaaaatgaaaatgtggataggcatgtagacctgctagaagttgcccaggaaactgatgggttttcaggaagtgacctaaaagagatgtgtcgagatgctgccctcctctgtgttagagaatatgttaattctacatcagaagaaagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctctttattggttgttctccacttaatctttggtctttttcagtaattttaagttttctgggattttttttggtttataaaacttgtgtttagactttatcttgctatggagttttcacacttctataggcacatatcctagtatctagtcatttctgttttaatatgaatttcagtaatttaattttaatctggtgacatattaatcgaaaataaggagtaatgtatacctccacatgtcctttctttttgtcttctcttaaattcacaatatccagtaggagtggttattcaatttcttcgtggttttaatcatcaaatgaagttagagaagtatactaatcccagcaactatgactcatctaggcatgttaagaccataaagtaattcaggaaactattttcctgatttttaaataacttttagtgttatgtaacatctatccttctgttttagacatgcatttcacatatagttgaattctagattctaagataattcattttgggtaatacttcagagtactggatctagaatcaggcttcctgaatttaaactcaggctccccattaactgtgtgtctgtgagcccagtttctcatctgtaaaatggggcaacagtggcactcatcttaaagggttggataataaaataatgcatgtaaggccctcagcatagtgcctggcacagaattactgctcaaatgttagctgtcgtattaatattgtcacttttgcacactgatgtacatttcctgttgaccaggctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcaggccttttttgtagagtttagaaatgaagtatttgaatcaatttagtatctcctttactatgtttctccttttaatctcagccaaccccctacctgcaggtaaacccagcattcattaagagctgggttggggtactctattctgtatgcatcataatagcttaacattatttagtagctgtaacttacaggtttaatgctagatgaggatgtctcaagccgtgagtgtgcttgtgtaaaaatggtggcaacatcatctcgttggtaggaattttttacttgaattgttattttgggaaaatgttaacagatttcttctggataaagaaaataaattggatgatgtatattttatgtttctttttagcttctcttaaaatcagaatattgaacagaattctgatatgctgaatatatatagtgcatggctgaaactccagcaccaactgggtgcttcaaatgaagtcatagaataattccatctagagctgacagaaatctttcagagccttcattattaaatttgttatagatttagttatcaaagatagagttctctaatcttttttttaaagctaaagttctctttatttacatgtataggaaaacattctgcctaaatcatgatgttaatgaaaatcatattgaggagaacttgaaccttattaaatatgagcttctaacataattgactaaaatgtgattgtcatatatgacacagatgctgtgtgcagatgatatcaaacctaaaaccacttagcaatgtgagaagaaacagaaaacatcccagttaccctggtgtaaaatttatactatttattaatggccgataagggtctcattactaaaacactgaagtgggattatatttttgtaatcgtctaatatttacagtcataaacctgcatgagaatactttcaaatactagcttttgtgcttttaaaataggtaacagtgaatgttagtattgggtgtgggatgcatcagggacacaggtttgtaaaccatgacaattcagttgtaaaactaaagccaagtgcacctgtagtcccagctgctggggaggatcacttgagcctaggaggtgaaaattgcagtgaactgatattgtgccattgcactccagactgggtgacatagtgagaccctgtctctacaaaaaaaaaaaaaaaaaaccctaaag

SEQ ID NO: 345054 - DNA, 4159 bp, Homo sapiens
ctgtatttttcaaataaaatgattaattctactaccaaataaatcttaatttctagtctacttctagtttgcaagaggagctttaaatgtatttgtttacttaacatttaaaaatccatttctccttaaaatgaaacactttttttaaggtaggtaatattttaatttgactagaagttagtttttctttcttagtttaagctactttgttagtcttacaattttaataagtatagttattacctagtgacatttctgtttgtttttttaaggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaaggtgttcttctctatgggcctccaggctgtggtcttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggtcatagtaatgggagctaccaatcgtcctcaggaccttgactcggctataatgagaagaatgcctacaagatttcatatcaaccagcctgctttaaaacagagagaagcaatcctgaaactcatcttgaaaaatgaaaatgtggataggcatgtagacctgctagaagttgcccaggaaactgatgggttttcaggaagtgacctaaaagagatgtgtcgagatgctgccctcctctgtgttagagaatatgttaattctacatcagaagaaagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctctttattggttgttctccacttaatctttggtctttttcagtaattttaagttttctgggattttttttggtttataaaacttgtgtttagactttatcttgctatggagttttcacacttctataggcacatatcctagtatctagtcatttctgttttaatatgaatttcagtaatttaattttaatctggtgacatattaatcgaaaataaggagtaatgtatacctccacatgtcctttctttttgtcttctcttaaattcacaatatccagtaggagtggttattcaatttcttcgtggttttaatcatcaaatgaagttagagaagtatactaatcccagcaactatgactcatctaggcatgttaagaccataaagtaattcaggaaactattttcctgatttttaaataacttttagtgttatgtaacatctatccttctgttttagacatgcatttcacatatagttgaattctagattctaagataattcattttgggtaatacttcagagtactggatctagaatcaggcttcctgaatttaaactcaggctccccattaactgtgtgtctgtgagcccagtttctcatctgtaaaatggggcaacagtggcactcatcttaaagggttggataataaaataatgcatgtaaggccctcagcatagtgcctggcacagaattactgctcaaatgttagctgtcgtattaatattgtcacttttgcacactgatgtacatttcctgttgaccaggctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcaggccttttttgtagagtttagaaatgaagtatttgaatcaatttagtatctcctttactatgtttctccttttaatctcagccaaccccctacctgcaggtaaacccagcattcattaagagctgggttggggtactctattctgtatgcatcataatagcttaacattatttagtagctgtaacttacaggtttaatgctagatgaggatgtctcaagccgtgagtgtgcttgtgtaaaaatggtggcaacatcatctcgttggtaggaattttttacttgaattgttattttgggaaaatgttaacagatttcttctggataaagaaaataaattggatgatgtatatttta

SEQ ID NO: 345055 - DNA, 4098 bp, Homo sapiens
ctcccaggttgcgtttccttcctgtgtgaggccggctgagggcacttgctcttgctgtttctgcccctgggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggtcatagtaatgggagctaccaatcgtcctcaggaccttgactcggctataatgagaagaatgcctacaagatttcatatcaaccagcctgctttaaaacagagagaagcaatcctgaaactcatcttgaaaaatgaaaatctgaggaaactgaaacccagagaagttttgtaataacttgcccaggattacacaaagaagtgatggagcctactcttaaccattagggtggataggcatgtagacctgctagaagttgcccaggaaactgatgggttttcaggaagtgacctaaaagagatgtgtcgagatgctgccctcctctgtgttagagaatatgttaattctacatcagaagaaagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctctttattggttgttctccacttaatctttggtctttttcagtaattttaagttttctgggattttttttggtttataaaacttgtgtttagactttatcttgctatggagttttcacacttctataggcacatatcctagtatctagtcatttctgttttaatatgaatttcagtaatttaattttaatctggtgacatattaatcgaaaataaggagtaatgtatacctccacatgtcctttctttttgtcttctcttaaattcacaatatccagtaggagtggttattcaatttcttcgtggttttaatcatcaaatgaagttagagaagtatactaatcccagcaactatgactcatctaggcatgttaagaccataaagtaattcaggaaactattttcctgatttttaaataacttttagtgttatgtaacatctatccttctgttttagacatgcatttcacatatagttgaattctagattctaagataattcattttgggtaatacttcagagtactggatctagaatcaggcttcctgaatttaaactcaggctccccattaactgtgtgtctgtgagcccagtttctcatctgtaaaatggggcaacagtggcactcatcttaaagggttggataataaaataatgcatgtaaggccctcagcatagtgcctggcacagaattactgctcaaatgttagctgtcgtattaatattgtcacttttgcacactgatgtacatttcctgttgaccaggctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcaggccttttttgtagagtttagaaatgaagtatttgaatcaatttagtatctcctttactatgtttctccttttaatctcagccaaccccctacctgcaggtaaacccagcattcattaagagctgggttggggtactctattctgtatgcatcataatagcttaacattatttagtagctgtaacttacaggtttaatgctagatgaggatgtctcaagccgtgagtgtgcttgtgtaaaaatggtggcaacatcatctcgttggtaggaattttttacttgaattgttattttgggaaaatgttaacagatttcttctggataaagaaaataaattggatgatgtatatttta

SEQ ID NO: 345056 - DNA, 2983 bp, Homo sapiens
  misc_feature (18)..(18): n is a, c, g, or t
  misc_feature (20)..(20): n is a, c, g, or t
  misc_feature (22)..(22): n is a, c, g, or t
  misc_feature (25)..(25): n is a, c, g, or t
  misc_feature (30)..(30): n is a, c, g, or t
  misc_feature (52)..(53): n is a, c, g, or t
  misc_feature (55)..(55): n is a, c, g, or t
gccctatagtcattctanananganaaagnccctatactggactcgtaagtnntnaagacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctctttattggttgttctccacttaatctttggtctttttcagtaattttaagttttctgggattttttttggtttataaaacttgtgtttagactttatcttgctatggagttttcacacttctataggcacatatcctagtatctagtcatttctgttttaatatgaatttcagtaatttaattttaatctggtgacatattaatcgaaaataaggagtaatgtatacctccacatgtcctttctttttgtcttctcttaaattcacaatatccagtaggagtggttattcaatttcttcgtggttttaatcatcaaatgaagttagagaagtatactaatcccagcaactatgactcatctaggcatgttaagaccataaagtaattcaggaaactattttcctgatttttaaataacttttagtgttatgtaacatctatccttctgttttagacatgcatttcacatatagttgaattctagattctaagataattcattttgggtaatacttcagagtactggatctagaatcaggcttcctgaatttaaactcaggctccccattaactgtgtgtctgtgagcccagtttctcatctgtaaaatggggcaacagtggcactcatcttaaagggttggataataaaataatgcatgtaaggccctcagcatagtgcctggcacagaattactgctcaaatgttagctgtcgtattaatattgtcacttttgcacactgatgtacatttcctgttgaccaggctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcaggccttttttgtagagtttagaaatgaagtatttgaatcaatttagtatctcctttactatgtttctccttttaatctcagccaaccccctacctgcaggtaaacccagcattcattaagagctgggttggggtactctattctgtatgcatcataatagcttaacattatttagtagctgtaacttacaggtttaatgctagatgaggatgtctcaagccgtgagtgtgcttgtgtaaaaatggtggcaacatcatctcgttggtaggaattttttacttgaattgttattttgggaaaatgttaacagatttcttctggataaagaaaataaattggatgatgtatatttta

SEQ ID NO: 345057 - DNA, 1796 bp, Homo sapiens
taggcggacctcccttccacagctccttcacagcgtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctctttattggttgttctccacttaatctttggtctttttcagtaattttaagttttctgggattttttttggtttataaaacttgtgtttagactttatcttgctatggagttttcacacttctataggcacatatcctagtatctagtcatttctgttttaatatgaatttcagtaatttaattttaatctggtgacatattaatcgaaaataaggagtaatgtatacctccacatgtcctttctttttgtcttctcttaaattcacaatatccagtaggagtggttattcaatttcttcgtggttttaatcatcaaatgaagttagagaagtatactaatcccagcaactatgactcatctaggcatgttaagaccataaagtaattcaggaaactattttcctgatttttaaataacttttagtgttatgtaacatctatccttctgttttagacatgcatttcacatatagttgaattctagattctaagataattcattttgggtaatacttcagagtactggatctagaatcaggcttcctgaatttaaactcaggctccccattaactgtgtgtctgtgagcccagtttctcatctgtaaaatggggcaacagtggcactcatcttaaagggttggataataaaataatgcatgtaaggccctcagcatagtgcctggcacagaattactgctcaaatgttagctgtcgtattaatattgtcacttttgcacactgatgtacatttcctgttgaccaggctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcaggccttttttgtagagtttagaaatgaagtatttgaatcaatttagtatctcctttactatgtttctccttttaatctcagccaaccccctacctgcaggtaaacccagcattcattaagagctgggttggggtactctattctgtatgcatcataatagcttaacattatttagtagctgtaacttacaggtttaatgctagatgaggatgtctcaagccgtgagtgtgcttgtgtaaaaatggtggcaacatcatctcgttggtaggaattttttacttgaattgttattttgggaaaatgttaacagatttcttctggataaagaaaataaattggatgatgtatatttta

SEQ ID NO: 345058 - DNA, 474 bp, Homo sapiens
ggaattatattcccatttcaataaaccatataacattttttaccttatggtaatattgtgtacttatagatgtgaagtctttgtagctattttagcttcctacttcttagcactcagtgcttttaaaaaattccttatgatttctctatgtgtagataattcctggaagcatttacatgaagctgttcattgtggttgtctttggggtcttgaatggtaaagagatttcatttttatacccttttctacagttgaaaacaaaattttttttttaccacatgcatctcttttaaatcttggtaaaatattttagggaggcatattctaaagttatttgagtatttgatggttttgtttgcattttagccatgacgaagatgaaattcggcctgttcaacagcaggacctgcatcgggcaattgaaaagatgaagaaatcaaaggatgcagcatttcagaatgttttaacacatgt

SEQ ID NO: 345059 - DNA, 2739 bp, Homo sapiens
ctcccaggttgcgtttccttcctgtgtgaggccggctgagggcacttgctcttgctgtttctgcccctgggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggtcatagtaatgggagctaccaatcgtcctcaggaccttgactcggctataatgagaagaatgcctacaagatttcatatcaaccagcctgctttaaaacagagagaagcaatcctgaaactcatcttgaaaaatgaaaatgtggataggcatgtagacctgctagaagttgcccaggaaactgatgggttttcaggaagtgacctaaaagagatgtgtcgagatgctgccctcctctgtgttagagaatatgttaattctacatcagaagaaagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctcttta

SEQ ID NO: 345060 - DNA, 2941 bp, Homo sapiens
ctgtatttttcaaataaaatgattaattctactaccaaataaatcttaatttctagtctacttctagtttgcaagaggagctttaaatgtatttgtttacttaacatttaaaaatccatttctccttaaaatgaaacactttttttaaggtaggtaatattttaatttgactagaagttagtttttctttcttagtttaagctactttgttagtcttacaattttaataagtatagttattacctagtgacatttctgtttgtttttttaaggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggtcatagtaatgggagctaccaatcgtcctcaggaccttgactcggctataatgagaagaatgcctacaagatttcatatcaaccagcctgctttaaaacagagagaagcaatcctgaaactcatcttgaaaaatgaaaatgtggataggcatgtagacctgctagaagttgcccaggaaactgatgggttttcaggaagtgacctaaaagagatgtgtcgagatgctgccctcctctgtgttagagaatatgttaattctacatcagaagaaagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctcttta

SEQ ID NO: 345061 - DNA, 4317 bp, Homo sapiens
ctcccaggttgcgtttccttcctgtgtgaggccggctgagggcacttgctcttgctgtttctgcccctgggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaagctatatcaataaagtgcattaatttacatatcaaaggtaactgaagcctgtacctgtgcatttttatgaactacataatttttgtttctggaaaagattgtttggaaaaaggcacatgtcctttggctaaaacttaatctgtgagcaacagcaaaacagtgtttgccacaatctgttttgaagttgtttaccttctgtaggctaatatcaaagcactatggtgcattgtttgcttgtgaaggtggagggccttagatgattttgtttttcaactgttgataaagtggtatgaatttggatgtcaaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggtcatagtaatgggagctaccaatcgtcctcaggaccttgactcggctataatgagaagaatgcctacaagatttcatatcaaccagcctgctttaaaacagagagaagcaatcctgaaactcatcttgaaaaatgaaaatgtggataggcatgtagacctgctagaagttgcccaggaaactgatgggttttcaggaagtgacctaaaagagatgtgtcgagatgctgccctcctctgtgttagagaatatgttaattctacatcagaagaaagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctctttattggttgttctccacttaatctttggtctttttcagtaattttaagttttctgggattttttttggtttataaaacttgtgtttagactttatcttgctatggagttttcacacttctataggcacatatcctagtatctagtcatttctgttttaatatgaatttcagtaatttaattttaatctggtgacatattaatcgaaaataaggagtaatgtatacctccacatgtcctttctttttgtcttctcttaaattcacaatatccagtaggagtggttattcaatttcttcgtggttttaatcatcaaatgaagttagagaagtatactaatcccagcaactatgactcatctaggcatgttaagaccataaagtaattcaggaaactattttcctgatttttaaataacttttagtgttatgtaacatctatccttctgttttagacatgcatttcacatatagttgaattctagattctaagataattcattttgggtaatacttcagagtactggatctagaatcaggcttcctgaatttaaactcaggctccccattaactgtgtgtctgtgagcccagtttctcatctgtaaaatggggcaacagtggcactcatcttaaagggttggataataaaataatgcatgtaaggccctcagcatagtgcctggcacagaattactgctcaaatgttagctgtcgtattaatattgtcacttttgcacactgatgtacatttcctgttgaccaggctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcaggccttttttgtagagtttagaaatgaagtatttgaatcaatttagtatctcctttactatgtttctccttttaatctcagccaaccccctacctgcaggtaaacccagcattcattaagagctgggttggggtactctattctgtatgcatcataatagcttaacattatttagtagctgtaacttacaggtttaatgctagatgaggatgtctcaagccgtgagtgtgcttgtgtaaaaatggtggcaacatcatctcgttggtaggaattttttacttgaattgttattttgggaaaatgttaacagatttcttctggataaagaaaataaattggatgatgtatatttta

SEQ ID NO: 345062 - DNA, 4201 bp, Homo sapiens
ctcccaggttgcgtttccttcctgtgtgaggccggctgagggcacttgctcttgctgtttctgcccctgggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggtcatagtaatgggagctaccaatcgtcctcaggaccttgactcggctataatgagaagaatgcctacaagatttcatatcaaccagcctgctttaaaacagagagaagcaatcctgaaactcatcttgaaaaatgaaaatgtggataggcatgtagacctgctagaagttgcccaggaaactgatgggttttcaggaagtgacctaaaagagatgtgtcgagatgctgccctcctctgtgttagagaatatgttaattctacatcagaagaaagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctctttattggttgttctccacttaatctttggtctttttcagtaattttaagttttctgggattttttttggtttataaaacttgtgtttagactttatcttgctatggagttttcacacttctataggcacatatcctagtatctagtcatttctgttttaatatgaatttcagtaatttaattttaatctggtgacatattaatcgaaaataaggagtaatgtatacctccacatgtcctttctttttgtcttctcttaaattcacaatatccagtaggagtggttattcaatttcttcgtggttttaatcatcaaatgaagttagagaagtatactaatcccagcaactatgactcatctaggcatgttaagaccataaagtaattcaggaaactattttcctgatttttaaataacttttagtgttatgtaacatctatccttctgttttagacatgcatttcacatatagttgaattctagattctaagataattcattttgggtaatacttcagagtactggatctagaatcaggcttcctgaatttaaactcaggctccccattaactgtgtgtctgtgagcccagtttctcatctgtaaaatggggcaacagtggcactcatcttaaagggttggataataaaataatgcatgtaaggccctcagcatagtgcctggcacagaattactgctcaaatgttagctgtcgtattaatattgtcacttttgcacactgatgtacatttcctgttgaccaggctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcaggccttttttgtagagtttagaaatgaagtatttgaatcaatttagtatctcctttactatgtttctccttttaatctcagccaaccccctacctgcaggtaaacccagcattcattaagagctgggttggggtactctattctgtatgcatcataatagcttaacattatttagtagctgtaacttacaggtttaatgctagatgaggatgtctcaagccgtgagtgtgcttgtgtaaaaatggtggcaacatcatctcgttggtaggaattttttacttgaattgttattttgggaaaatgttaacagatttcttctggataaagaaaataaattggatgatgtatattttatgtttctttttagcttctcttaaaatcagaatattgaacagaattctgatatgctgaatatatatagtgcatggctgaaactccagcaccaactgggtgcttcaaatgaagtcatagaataattccatctagagctgacagaaatctttcagagccttcattattaaatttgttatagatttagttatca

SEQ ID NO: 345063 - DNA, 3957 bp, Homo sapiens
ctcccaggttgcgtttccttcctgtgtgaggccggctgagggcacttgctcttgctgtttctgcccctgggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggtcatagtaatgggagctaccaatcgtcctcaggaccttgactcggctataatgagaagaatgcctacaagatttcatatcaaccagcctgctttaaaacagagagaagcaatcctgaaactcatcttgaaaaatgaaaatgtggataggcatgtagacctgctagaagttgcccaggaaactgatgggttttcaggaagtgacctaaaagagatgtgtcgagatgctgccctcctctgtgttagagaatatgttaattctacatcagaagaaagccatgacgaagatgaaattcggcctgttcaacagcaggacctgcatcgggcaattggtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctctttattggttgttctccacttaatctttggtctttttcagtaattttaagttttctgggattttttttggtttataaaacttgtgtttagactttatcttgctatggagttttcacacttctataggcacatatcctagtatctagtcatttctgttttaatatgaatttcagtaatttaattttaatctggtgacatattaatcgaaaataaggagtaatgtatacctccacatgtcctttctttttgtcttctcttaaattcacaatatccagtaggagtggttattcaatttcttcgtggttttaatcatcaaatgaagttagagaagtatactaatcccagcaactatgactcatctaggcatgttaagaccataaagtaattcaggaaactattttcctgatttttaaataacttttagtgttatgtaacatctatccttctgttttagacatgcatttcacatatagttgaattctagattctaagataattcattttgggtaatacttcagagtactggatctagaatcaggcttcctgaatttaaactcaggctccccattaactgtgtgtctgtgagcccagtttctcatctgtaaaatggggcaacagtggcactcatcttaaagggttggataataaaataatgcatgtaaggccctcagcatagtgcctggcacagaattactgctcaaatgttagctgtcgtattaatattgtcacttttgcacactgatgtacatttcctgttgaccaggctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcaggccttttttgtagagtttagaaatgaagtatttgaatcaatttagtatctcctttactatgtttctccttttaatctcagccaaccccctacctgcaggtaaacccagcattcattaagagctgggttggggtactctattctgtatgcatcataatagcttaacattatttagtagctgtaacttacaggtttaatgctagatgaggatgtctcaagccgtgagtgtgcttgtgtaaaaatggtggcaacatcatctcgttggtaggaattttttacttgaattgttattttgggaaaatgttaacagatttcttctggataaagaaaataaattggatgatgtatatttta

SEQ ID NO: 345064 - DNA, 576 bp, Homo sapiens
tcctgggctcaagcattcctcccactttgcctcccaaaatgctgagatttactggcatgagctactgcgcctggcatatcagctttttgtgtatgtgtctttagagatgcagtcccttggccagtataatttttacaagtctgaaattccagtttctaatcgtgtttattttgttagaaactgatttttttttctccttaagtcatgacagaggcattctatcaggtataattaattggtcacagttgaatcatgatgagatggcttagtttataatccaaattcatgtgagaaggacatatttctttgctctgttttctactctgtttattagaaaaaattagtattgaagtatttttcttaaggcagaataatattgaaataggggtattgtaacggcatattttacttcagatctaaagtttaaatatgatggttttaatctcaaaagaaatagtaaaattgctgtgtatgccaagaaaacttgtacaaacgtaatcttcataaaccaatagtaatatatatttatttctggttggttattttttaagctgccttcagtaggagcttttgctc

SEQ ID NO: 345065 - DNA, 467 bp, Homo sapiens
tgtagacactgggttttgtcatgttgcccaggctggactcaaactcctggcctcaagcaatcgcctgcctcagcctcccaaagtgctgggattacaagtgtaagacactacatccaacctacacttttaaaaattatcccacagttcttggatattctgctgtttttaaaaattttccattcctttttgaaatctttcaatttcaatttgggaagtttctattgacatatcttcaagttcactgattctttctggctgtgttcagtcttatgagcccatcaaagtcattcatctctgtttcagtgttttatttctagctttttcttttttttttttgagacagagtttcgctcttgttgcccaggctggagtgcaatgacacgatcttggctcactgcaacctccacctcccggattcaagctattctcctgcctcagcctctcgagtagctgggattacaggcatg

SEQ ID NO: 345066 - DNA, 2694 bp, Homo sapiens
tccgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttggagttca

SEQ ID NO: 345067 - DNA, 688 bp, Homo sapiens
tccgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccataccttatgagtgcaatgcgtgaacccccggtggctagaaaggaatccaggatttgaatctgaactccttaaacacaaatgggggcttttttatcccccccatttaggaaaccc

SEQ ID NO: 345068 - DNA, 281 bp, Homo sapiens
ctctgagtttgttgacctttgctcagggacacttcaggagctagtttctaattgttttctttcagtggtaggagtgaaggtggcaggaattcccgggtcacccctgcagctgccaactaccgcagcagaactgcaaagtaaggtgggctccagcccatgatgctcagtgggggactcagacatggtggggcttgtgtggctcctgaagttgtagaagttgttgggaccaggctggttgtggttcaaagattgttcctttggcttttgagaaggaggtttct

SEQ ID NO: 345069 - DNA, 2801 bp, Homo sapiens
  misc_feature (2748)..(2748): n is a, c, g, or t
  misc_feature (2750)..(2750): n is a, c, g, or t
  misc_feature (2752)..(2752): n is a, c, g, or t
  misc_feature (2772)..(2772): n is a, c, g, or t
  misc_feature (2774)..(2775): n is a, c, g, or t
  misc_feature (2777)..(2778): n is a, c, g, or t
  misc_feature (2784)..(2785): n is a, c, g, or t
tccgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttggagttcaaaacaaaaacaaaaaaacaaaaaaaacaacaaaggggggcgcgcggcccaaaanantntccccgcggggggcgcccangnntnnacgcgnngtcacccaggtttttt

SEQ ID NO: 345070 - DNA, 2875 bp, Homo sapiens
tccgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcttagatatgatctttgaaccactaaactaagtgagaaaggcaaaaatgaagtggagagaccagactggtggaggaaagggttcaggatttcatttttgtacagctttacagtgaagtttctaccaacccagccagagagcatgttcctgtagtcaggaagcatccagcctgcttcgaaagcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttggagttca

SEQ ID NO: 345071 - DNA, 2540 bp, Homo sapiens
tccgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggacggtgcgttgcccaacgggatcctgtagaatcgactacaaggatacagct

SEQ ID NO: 345072 - DNA, 2338 bp, Homo sapiens
tccgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccaggtatgttgggctctgccccagccccacacttgctctgaaaaccaagtgtcagagccccttccccttgtttttattttactgttataataattattaacttccttgtaatagaaataaagtttgtacttggagttca

SEQ ID NO: 345073 - DNA, 2450 bp, Homo sapiens
  misc_feature (2397)..(2397): n is a, c, g, or t
  misc_feature (2399)..(2399): n is a, c, g, or t
  misc_feature (2401)..(2401): n is a, c, g, or t
  misc_feature (2421)..(2421): n is a, c, g, or t
  misc_feature (2423)..(2424): n is a, c, g, or t
  misc_feature (2426)..(2427): n is a, c, g, or t
  misc_feature (2433)..(2434): n is a, c, g, or t
tccgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttggagttcaaaaaagaaacaaaaaaacaaacaagcgaaacaaaaacaaaaaaacaaaaaaaacaacaaaggggggcgcgcggcccaaaanantntccccgcggggggcgcccangnntnnacgcgnngtcacccaggtttttt

SEQ ID NO: 345074 - DNA, 1967 bp, Homo sapiens
tccgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaagtaaggtgggctccagcccatgatgctcagtgggggactcagacatggtggggcttgtgtggctcctgaagttgtagaagttgttgggaccaggctggttgtggttcaaagattgttcctttggcttttgagaaggaggtttct

SEQ ID NO: 345075 - DNA, 1945 bp, Homo sapiens
tccgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctaggtaagaatcagtagcccaggaatggggcttgggagtagctgaagcgaacatgggcaaaggcctggttacccttgccaggcctggggtaagactgaggtacttgcatggtaaggggaggagtatggattttccctgtattgtcacctgactccaaaaaaaaaattattttgtggcctatgggttttttggggttt

SEQ ID NO: 345076 - DNA, 2487 bp, Homo sapiens
  misc_feature (786)..(786): n is a, c, g, or t
  misc_feature (834)..(834): n is a, c, g, or t
  misc_feature (862)..(862): n is a, c, g, or t
ggctgggttgaggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaanccttcacgtgccttacccttcgacatccaaataagctggaccagggcntccgtgtcccccacgcccaggaagcgcngggcatgggggaacggcggaaaaccccggtgagaactggggttccaagttccgtgtccgcaaagggaaaaacccgatctatcgtgtggcaaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttggagttca

SEQ ID NO: 345077 - DNA, 1527 bp, Homo sapiens
atatgagctggcccactattccacggttggctcaccaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttggagttca

SEQ ID NO: 345078 - DNA, 1280 bp, Homo sapiens
tccgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagctcaatcagcagttcctctgggtagagctcctcacaaaattcacaaggcaacatgatctcgtcagctcaccctttatg

SEQ ID NO: 345079 - DNA, 1008 bp, Homo sapiens
ctctgagtttgttgacctttgctcagggacacttcaggagctagtttctaattgttttctttcagtggtaggagtgaaggtggcaggaattcccgggtcacccctgcagctgccaactaccgcagcagaactgcaaaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttggagttca

SEQ ID NO: 345080 - DNA, 1101 bp, Homo sapiens
tccgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtaggcttgcttattctgcactagcctctttctctacagttttgtaagtcttaggttatacaattcttatacaattgaaagattttaatgaaatagaatttgccttactcttttttgtt

SEQ ID NO: 345081 - DNA, 364 bp, Homo sapiens
tcttggctcactgcagtcttcacctcctgggtttaagtgattctcctggtctcagcctcctgagtagctgagactatagctgtgtgccacctcacctggctaattttgtattttttttttagtagagatggaatttcaccatgttggccaggctggtctctaactcttgacctcaggtgatccccgcacctcggcctcccaaagtgctgggtttacaggcatgagccaccacgcctggctgagcagttgtcttctatctggaatctttttgttcctgccctaaacctggcactatagccagagcaggctttttcctaaagctgttaccattttctcttctcaggagacctgtcttctggttacc

SEQ ID NO: 345082 - DNA, 410 bp, Homo sapiens
tgaattctgtggggtacagctggaagaggaggtgctgttccatcaccaggtaagggtccctggagtccctgtccatgtggctctgtgcgtgaacctgaggcttccagagctgagaacacttccttagcctttaagttgcattccatcctgacaaggaatgcacacacttggcttctggccaagtcatctttgtgagctgtctgtggtaaccaataccgcaggctttcagactttccctccctttgggcaactgaagccatcttgttactagctgaggaccaaagagccaggactctatttgagcaggtgtggaaggaagccttgtcagagagtttagatgacagtctccctgcttttcaccaggtgggtttttcccattgtggtggcatttgagacttgcattctaggag

SEQ ID NO: 345083 - DNA, 96 bp, Homo sapiens
ccagaggaactgctgattgaccatcaggtgtgttatgaattacttgaggacttttagtaggattgtatgcaggccataattggtgttgcaggccac

SEQ ID NO: 345084 - DNA, 2316 bp, Homo sapiens
tccgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttggagttca

SEQ ID NO: 345085 - DNA, 2772 bp, Homo sapiens
  misc_feature (1071)..(1071): n is a, c, g, or t
  misc_feature (1119)..(1119): n is a, c, g, or t
  misc_feature (1147)..(1147): n is a, c, g, or t
tccgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaanccttcacgtgccttacccttcgacatccaaataagctggaccagggcntccgtgtcccccacgcccaggaagcgcngggcatgggggaacggcggaaaaccccggtgagaactggggttccaagttccgtgtccgcaaagggaaaaacccgatctatcgtgtggcaaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttggagttca

SEQ ID NO: 345086 - DNA, 3226 bp, Homo sapiens
tccgcgatgggcggaagtggtgaggcagctctgagggccgttgttcagtgcggggtctgacagaggaggctccgtgtctgcagctagtgtgtcaactcagcgtttctcctctcgtccctggtgaggtgtagcggcggcacgcggctggagatcccctgtggcctccagtttaggaagggtccagcatcccaagggaggggtgtgtgggcgaggggtctctgggcccggggtcgcggctgtgaggagaggatgcccgcgcggcggcatctcaggcacctggaggaggccgcgctttctcctcagggaaccggcgccttggcagcccccggcgacgccgcccccttcgcggcctaggttggtctggtgagccgggaagcgggcgtcgttcgcagcgccgctgtgaccaccgcgtcccgggcggagctgggctcagtgccggcctgggcctagagtccgagcctcgagctgccggcgtggggggtcgcgagtggcctaatgcggcctcgaagccgaaggacccgagtccgagctcgcactccgacccgctggtgctgtggaaaactcaggtggccttccgctttcgtagcctctaaagtggggaccaagactttcacctcttaggattgtagtcgggattaacaagattttcccggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttggagttca

SEQ ID NO: 345087 - DNA, 2828 bp, Homo sapiens
  misc_feature (2775)..(2775): n is a, c, g, or t
  misc_feature (2777)..(2777): n is a, c, g, or t
  misc_feature (2779)..(2779): n is a, c, g, or t
  misc_feature (2799)..(2799): n is a, c, g, or t
  misc_feature (2801)..(2802): n is a, c, g, or t
  misc_feature (2804)..(2805): n is a, c, g, or t
  misc_feature (2811)..(2812): n is a, c, g, or t
tccgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttggagttcaaaaaagaaacaaaaaaacaaacaagcgaaacaaaaacaaaaaaacaaaaaaaacaacaaaggggggcgcgcggcccaaaanantntccccgcggggggcgcccangnntnnacgcgnngtcacccaggtttttt

SEQ ID NO: 345088 - DNA, 2393 bp, Homo sapiens
  misc_feature (24)..(24): n is a, c, g, or t
catggaagagggcggcgggtgaantcggcacggaggagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttggagttca

SEQ ID NO: 345089 - DNA, 1350 bp, Homo sapiens
tccgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccgacgcccagccattggcaaccacggtctctcaaggtaccgagctcga

SEQ ID NO: 345090 - DNA, 1256 bp, Homo sapiens
tccgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttggagttca

SEQ ID NO: 345091 - DNA, 1112 bp, Homo sapiens
tccgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctcttggagcacctttgtctgcgcccacacgggtatcatcttctatgctcaatacacaggagtctgttagcagcacaagcgaatga

SEQ ID NO: 345092 - DNA, 1164 bp, Homo sapiens
tccgcgatgggcggaagtggtgaggcagctctgagggccgttgttcagtgcggggtctgacagaggaggctccgtgtctgcagctagtgtgtcaactcagcgtttctcctctcgtccctggtgaggtgtagcggcggcacgcggctggagatcccctgtggcctccagtttaggaagggtccagcatcccaagggaggggtgtgtgggcgaggggtctctgggcccggggtcgcggctgtgaggagaggatgcccgcgcggcggcatctcaggcacctggaggaggccgcgctttctcctcagggaaccggcgccttggcagcccccggcgacgccgcccccttcgcggcctaggttggtctggtgagccgggaagcgggcgtcgttcgcagcgccgctgtgaccaccgcgtcccgggcggagctgggctcagtgccggcctgggcctagagtccgagcctcgagctgccggcgtggggggtcgcgagtggcctaatgcggcctcgaagccgaaggacccgagtccgagctcgcactccgacccgctggtgctgtggaaaactcaggtggccttccgctttcgtagcctctaaagtggggaccaagactttcacctcttaggattgtagtcgggattaacaagattttcccggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgatgggagcaagatgggtcttgctcccatcagtacacaacgctgtagttgttgtcctgcaatcctttgtatttacctcattctttcccatctaagtcctcactgagttttaaagttagggctggaaaagctatgccttactgggacagcaggaaccaatttttttctgatggaagcagactgcggtccgagccta

SEQ ID NO: 345093 - DNA, 410 bp, Homo sapiens
gggttcatgacacagaacagggtaagagccactggcatggacactagaaacctacaccaatgctgttgtatcacttttcagacaagctctgtgcagtcggaattttttaaagatgcactgtcacttgaggaagacaggtgatcttctgcggcacaaatagaagcaaagagatttctcttcttctctgtagagcaacacaattgataaatggccgataatctccaccaaattggcagcagtaggctgcccgaaggcagcaggcatattcgtctttgtgaattgttttactatgatgctgtcacatttccaggaataagacggttaaaatgatatattgttgtggtttggcatttgcagctttgctctgacttccctggtaactgccaacatctgcaaattattatgtgctt

SEQ ID NO: 345094 - DNA, 407 bp, Homo sapiens
tcccagagtgctgggattacaggaatgcaccactgtgcccagccctaaataactatttttatttccctttctgtaaccgctcatcttttgtgcatttttcttgggtattggccttcttatcaaagtttaagaactgtttatatatagggattaacccttagtctgttgtatgaattgcaaatatacatgtatttatttgtatatgcaaagtttgtcttttatctttgtatatgggatagttttccaaacacagttttattttattttatttttcatcttgcatgtctttccaaagtaccaagcagagtttttttaaaagttgttttatggcttctgggttttttaagtcatatttagaaagatctttcccactctgaaattaaaaaaataaataaataaaatctccc

SEQ ID NO: 345095 - DNA, 1014 bp, Homo sapiens
atattttgcacttttattataaaaagaagcattttcttatatagatatacaataaattactatgagatgaaagattataaagctcacttataactatttagagttaaccacacacttgaaaaaaatgcaattttacaacaaagttataattcccattagggaaactaaggaaaaattaacctatagaagaaacaaagagacaaaatttccacattttaattacatagtgatcaaacacacaatgtaattgtctaaattaccaaattcttagggtaaagatgttattaatacttagagtaaattaaagagaacctcaccaaaactaatcaaagacttaaatggatatttataaatgtagggtctaacagaaaaaacagatgtccgagaactacaaacaaatcagacaaagcccacagacatcttagggacagaagatattcaaattttatccaatgttctccttaaagtagcagcagatacgctatacacttcctattggtctgatgtaatcttcacacatacacaaaatcacaccagacaagcactatcatacacacatctggaagatggggaagggaaggcccagagaggtgaaggtatttgcccaggatacagagtcatcagaacctgaagccaacagccagacccaaatcagacttcagaacctaagctcttgagctcaaacccacagagataaagtagtcagatgagttacaatgagataaaccggtaggtggtatatgcccactggtattgcagtactaaacatagcagacccatggcaaagaacacaatatactttatgtcaagaaagattaattttagctccatcaatcacaatgcatttctgaaaaaacctacaagcaaaattagtgaagcaaacaagagtatctcaggtgtaaagagctatttggacaaaatgactagcaaatttaaaaattacaaatcatgaacttcctagagctctatctaatctcagaccctaggtacgtgcatcagtaaatacagaacctt

SEQ ID NO: 345096 - DNA, 759 bp, Homo sapiens
tgaggatcccctgctcttccgtgccctaatttttagttacatggcttttatttgctttaatagcatgcgagaaggtagaggaaaatgtggttgcatcttgtagggtctaacagaaaaaacagatgtccgagaactacaaacaaatcagacaaagcccacagacatcttagggacagaagatattcaaattttatccaatgttctccttaaagtagcagcagatacgctatacacttcctattggtctgatgtaatcttcacacatacacaaaatcacaccagacaagcactatcatacacacatctggaagatggggaagggaaggcccagagaggtgaaggtatttgcccaggatacagagtcatcagaacctgaagccaacagccagacccaaatcagacttcagaacctaagctcttgagctcaaacccacagagataaagtagtcagatgagttacaatgagataaaccggtaggtggtatatgcccactggtattgcagtactaaacatagcagacccatggcaaagaacacaatatactttatgtcaagaaagattaattttagctccatcaatcacaatgcatttctgaaaaaacctacaagcaaaattagtgaagcaaacaagagtatctcaggtgtaaagagctatttggacaaaatgactagcaaatttaaaaattacaaatcatgaacttcctagagctctatctaatctcagaccctaggtacgtgcatcagtaaatacagaacctt

SEQ ID NO: 345097 - DNA, 1105 bp, Homo sapiens
tgttacaaaacagtaaaccatattaatacacatgtacacacatacataggcccagaaaatcacctagaaagatgtggactggtgtttaatactggatagtggaaagattttaatattaacttttatatttttaatgtttttcactattttcatatttttctactatgactatgtataacttttacaagtttttaaaacctttaaaaaaagccgggtgcggtggctcacacctcaatcagcacatatttttaagcagtttacacatggcaaactaattcccaaacaggtcattcaaaatgtttcatgacaaacaacctcaattatatattattagtggatggattttcatcctgtgtcaaaagccacttagtatgaaaatctcacctggtatctgtctatccatccctcacaagtactagtacttcatgattaccaaaagatgctggcaacataatacaagaaaaggaataaaataaaggagcacccagagccttctgcctggagagattatcagttattttttgtctgtcttagaaaaccttctgcctgggcattccaatctttttagcaaatctggtattcattatccacacttgttggtattctctcatacaattctaaggttgccctggggccacccctctgaaaacagatttgccctgtgatgtacaatcccaagcaactggccatatctttcattggtaatgggtgaggagaaaggagcagagctcctgcaagtgaagcagggaactgtacaacataaacatttcaggatcactgacatccacatcatggctaacgtgcctatgtactgcaagatgagactgtcagcagatcattttcaaattttaacagactacttggtcatgtttgattcctaaatacgcctttggcttatttattatctgtagtataattttatagtcatagagtttataaagtaaaaagtactaatccaaaagctagaagaagacaagaaataactaagatcagagaagaattgaaggagacagagacaagaaaaactctccaaaaaaatcaatgaatccagaagctggttttttgaaaaaattaaaatagaccactagctagacttataaagacg

SEQ ID NO: 345098 - DNA, 620 bp, Homo sapiens
agagcagccagattgtaagcaggcttgttcaatgtcgcgattatattactaaagctagttccatgcgggaagatcttgtagagaaaaatgagagtctccgtcgaactagttcacggagactctcatacaattctaaggttgccctggggccacccctctgaaaacagatttgccctgtgatgtacaatcccaagcaactggccatatctttcattggtaatgggtgaggagaaaggagcagagctcctgcaagtgaagcagggaactgtacaacataaacatttcaggatcactgacatccacatcatggctaacgtgcctatgtactgcaagatgagactgtcagcagatcattttcaaattttaacagactacttggtcatgtttgattcctaaatacgcctttggcttatttattatctgtagtataattttatagtcatagagtttataaagtaaaaagtactaatccaaaagctagaagaagacaagaaataactaagatcagagaagaattgaaggagacagagacaagaaaaactctccaaaaaaatcaatgaatccagaagctggttttttgaaaaaattaaaatagaccactagctagacttataaagacg

SEQ ID NO: 345099 - DNA, 458 bp, Homo sapiens
ttttttgaaatgaagtctcactctgtcacccaggctggagtacagtaacacaatcttggctccctgtaacctccacctcccaagttcaagcaattcctgtctcagcctcctgtgtagctgggactacaggcatgtgacaccacacctggctaatttttgtatttttagtagtgacgggtttcgccatgttggccaggctggtctcaaactcctgacctcaggtgatccacccacctcaagctcccaaagtgctgggattacaggcgtgagtcactgcacctggccaatcagcacatatttttaagcagtttacacatggcaaactaattcccaaacaggtcattcaaaatgtttcatgacaaacaacctcaattatatattattagtggatggattttcatcctgtgtcaaaagccacttagtatgaaaatctcacctggtatctgtctatccatccc

SEQ ID NO: 345100 - DNA, 629 bp, Homo sapiens
ggggaacctgaggccgacttggcctgaaggaagtgacatgagcataaggaagtggggtgcggtgggagcgggtcaagtgacagaggagggctgggaaatattaatgaatagagtctgttgagaatcagccaatgtgacttgaagcaacaggcaaccagaatcgtgatgggtcagtatttcccccaggcctatccagaccaggtcttatcctcctagcaacgcggccctctcggctcttaaggcgtgacttgccatggatgttctgcctttggaaccagtgggtggtcacagcacagaggctgttggtttcatggctgtcacatgcacagagacagccctgtccactgagcctgttctgtggcagaaggaaccccctagcctggaccatctttgggtggaaacaccagcccctcacgtctgactgtcattttcagatgtgaagagaacacacagtgttgctgatgtgtttgtattgcctgtaaacaacgaagagtttctttgacttcttaactgccttaaagctagaagcccggcattaggatggcagtggtggtaatgaggttatgttttgagacttggcctcattagaagtgatgttctttatttgggcacttaggccacatataaaa

SEQ ID NO: 345101 - DNA, 642 bp, Homo sapiens
gtaatagattcaagcccatttaatatacttcctggacttgaattgttacctggatcaccccactgtcattccagcaaaaagatccatgatacgttcttctcaccattaggttctcttagatatgggaattcttttttcttttctctctctcttttttgagatggagtctcactctgtcaccaggctggagtttagtggtgtgatcttggctcactgcaacctctgcctcccaggttcaagtgattctcctgcctcagcctcccaagtagctgggattacaggcttgtgccaccacacccagctaatttttgtatatttagtagagactgggtttcaccttgttggccaggatggtctcagtctcctgaccttgtgatctgcccacctcggcctcccaaagtgctgggattacaggcatgagccatggcgcccagccagatatgggaattcttatgacactatggcagtatgcatcataattcttacaaaccagatacattatctctgagggctttctgtggtttccttaacatataaacagaaagtcagaacttgttgtattttggtatactagaatttgaaagagtttgatttctacagttttctgaccacagtaaatccagtgttgacatcttgatgcct

SEQ ID NO: 345102 - DNA, 360 bp, Homo sapiens
ctcaagcttctcggtctgcctgtgcgaaggggcctaaggctgggtgttaagtcccatagcatgagcaaaacctgtaatttagggttaaccagctttacttaactcccattaccccttttccttctcctcattcttagaattctcacgtgagtggtagtaagcccctaggatgtatgtatgctgctgtgtatgtgcttagccatttcctgtgtatttaatggtgaacctttggtgattcctcacatggaacccttttgcccttggtcacacttgtgaaagcacctccacatctttgcaatcagatcagcctaggccaggaagcaccttagaggaggtgattgactctagttccttgtttgg

SEQ ID NO: 345103 - DNA, 2149 bp, Homo sapiens
ggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagcca

SEQ ID NO: 345104 - DNA, 2270 bp, Homo sapiens
attgcctccccgacccacactggctggactactgcccaggacagaagaggggggttggctgtgagtggggaggaggtggaagcggtagattcccagcacaaccttcttcctcccacccccaaaacctccatctgaagaaggcctgaggaagctgtcaggctgcctgcctgattcatcccttccctctgggcgtagccactgagtctgctgggctgatgcttctgaatacaaactatggcacctggaaggcactgcagagaaaggggggacctcagggctcccattccatcactcttgagtctaggtcataccctccacaatccccaagaggcccgtactgtctcttctgatgggactcctgggttctgtgttgcccaccctgcaaatctgcatgccagcaagtatgggtgacccggctggctgctgggtcaccttcatttgggtgctagccttgctgccttcctttggtgctgttgagattgtccttgccgtgttcactcccagcgcaggcatgccctggccccaggctgtggctccgattcactcttactgccatgctttgttctcattttttgcttccacagtaagtctgcacaaaatactgtcctcacagctgagcttacctggtgatctattcttttttctcggtcactacttgtccagcttttttttttagacttttggagacagtgattgacaacagaacctagcagccagggctgcgctagtcccctagccccctccagagcctgtgtcaggcatatgactgactgcatcctctcccctctctctcctctctgccccagatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgtaagtgtcttgcttgagaaggcaggatgctcccctgcccatgggaaaagctggtgagcagtcaggagtgctgggtaggaatgaggctggcgctcaggagctggcctggcctcctgccctcccctctctcagctgctggacccgaggtatgaaggaggcctgtggctggtcaggaagtgcactggtttgtgtgttcactctgcagcctctaaaacccatccactggtgtctcaggtgcacccaaagggaaagctgctggactgtaactatagaagattctatttctgtataagcctttgcctgacatgagaatcgtttgaaggcagaacagtgggatagtgaaggtaggtgtatggtggaggccagagccagagtggtgctgggttagcccgaagctttgctcctgagcagaacctagggttacttgctgtctctacccgccttgtcttctgtttttgcctctgggcaggaataagaattggatggggattctagatcccacacctacaaaaccctgagtttccagcccttaacagtgtgtccacctgactggagcagctgcctctggggaaaccacctgcccctggcctgttctgccgcttcatggatgtcaggcaggagaaagcctctggtggccaggggagcaagccctgctcctcagctgtggtgcctgagggcctctcagcaagccttccataccatgggctggatgaatggcacatgctggggccttaccaccagcaccgcaatccagctcatcccccccacccctgttggcaggtgggaggcagggtgccttggggagttgggaagggaaagggggccctggatcctagctgagggcagtcaggagccagtcagaccttgaaattccaggatggcacaggtcctggctctgcagctgtgaagtcatcaaagagcttctgaggtcactgtgcctggcacagcctcctctgcagccagcccctaggctagaaacaagatcttagatgttcgaaggcttaaaaaaaaaaaaattgcaggccgggcatggtggctcacgcctgtagtcccagcacttagggaggccgaggcgggcggatcacctaaggttgggagttcgagaccaacctgaccaacatggagaaaccccgtctctactaaaaatacaaaattagctgggcgaggtggtgaatgcctattagtaatcccagctactcgggaggctgaggcaggagaatcgtttgaacctgggaagcggaggttgccgtgagtcgagatcatgccattgcactccagcctgggcaacaagagcgaaactctctcaaa

SEQ ID NO: 345105 - DNA, 2305 bp, Homo sapiens
ggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttgatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagcca

SEQ ID NO: 345106 - DNA, 2329 bp, Homo sapiens
ggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggaggaagagccactcatcctctccacagagtgtcctctggaaccggccacaaccctcagaggaccgcttgccttcccagcaggggctggcggaagccaggtcttccagctcctcttcctcaaaccattctgataactttttcaggatgggtagcagtcccctggaggtccccaaacccaggcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagcca

SEQ ID NO: 345107 - DNA, 3136 bp, Homo sapiens
ggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggaggaagagccactcatcctctccacagagtgtcctctggaaccggccacaaccctcagaggaccgcttgccttcccagcaggggctggcggaagccaggtcttccagctcctcttcctcaaaccattctgataactttttcaggatgggtagcagtcccctggaggtccccaaacccagatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagccaaaaaaaaaaaaaaaaaaaaaaaaaaaaaaaaacaaaaaaaaaaaaaaaaaaacaaaaacaaacaaaacaaacaaaaaacaaaaaaaaaaaaaaaaaaacaaaaaagaaagaagcgagggggcgccaaggaccatcacctacaccaagaagaaagacgaaagaaccacgcgccaccactgcacaagcagacgcagaccaaagaaaggagggacgggaacagtaaaaaaaacgaaagacgaagagggaaagaaagcaaatacaacaaaacccaagagagcgaggaggaaagagaaaacaaggagagacagacaacaaacaacgagaaggcaaaacaacaacgcaactcgaagcggagacaaaacagaaagacacaacagagaaacaaacaaagaagaaagaagagcaaacgacaacgaccacggacggcaagacataaccacgaaaaccaaaaaagcagagaacagaagaaaagaaagcaagagggagccggactacacgcaacaagactgcaacaagagacagatagagccagcaggcagcagaagcagaacgcaagagcgaacgacgcagcagaaacaatagaaaacacatgacaacaaaaaagaaccctacactaccgccggacacgaagaggcaaggaacaagaccgaa

SEQ ID NO: 345108 - DNA, 2627 bp, Homo sapiens
ggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggaggaagagccactcatcctctccacagagtgtcctctggaaccggccacaaccctcagaggaccgcttgccttcccagcaggggctggcggaagccaggtcttccagctcctcttcctcaaaccattctgataactttttcaggatgggtagcagtcccctggaggtccccaaacccagatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagccaaaaaaaaaaaaaaaaaactcgagctctcttttttacttttctttctttttctctttttttttttttttctttttttttttgggaaagggaatttaactttgtcatggaggctggagtgcaggggccctgtgtcaccttgggc

SEQ ID NO: 345109 - DNA, 2156 bp, Homo sapiens
ggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttgatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagcca

SEQ ID NO: 345110 - DNA, 2273 bp, Homo sapiens
ggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggaggaagagccactcatcctctccacagagtgtcctctggaaccggccacaaccctcagaggaccgcttgccttcccagcaggggctggcggaagccaggtcttccagctcctcttcctcaaaccattctgataactttttcaggatgggtagcagtcccctggaggtccccaaacccagatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagcca

SEQ ID NO: 345111 - DNA, 609 bp, Homo sapiens
ggaggcccctgtgtggagccctgggtcaccagcctcagtactgacagataggtttctctggcagggggtgcagatgatgcctgggcagatgtggaggacgtcacggaggaggactgtgctcttcggtcagtgctgggttgctgtggtcaggggcttgtgttggggatggggtgtctggccagagatggccatgttcatattgtccgtgggtatttgtcactggttcaggtgagtggattggcttcttcctcttctgtctgccaagtctgtgcccctgaaatatggctgttgaagtccactgggtagcagccaaatacctgagcagtctgtccccatcttgactgcacacctggattcacagagaacatcccactcttggggttcctggtactgcaggcccgagatagggcccagacatctatatttgttttaaagccccacagagttgccagtttgcagctatgatgctgattaccaacctgccagatctcacccagtacagctggtactgaggcacagggcaagggctacagtccatacataggagacatgaggtctagcctggaaggcacatttggagaccagatgtgtcacagctgcatgattggt

SEQ ID NO: 345112 - DNA, 418 bp, Homo sapiens
acccatgcgtccacctagcacacgccccagcttctggagaagagtgacatccatacttccctgaatgagtgcccacccccaagctcctgtgagtgaacatgccatgtaacttctccctctggctctttatttcagaagtggtgacacgcatctttttgataaggtcagaggctatgacatcaagctgcttcgatacctgtcagtcaaatacatctgtgacctgatggtggagaacaagaaggtgaagtttggcatgaagtaagtacaggcgcccactacaaaatgagcagaggcagtgtgtacagatttgcagggctggcgttagtatgtagctgtcactgcgtgctggccttcttacaaagggctttctgtacattatctcactgtatcttcagacagccctgcaaaataggtacca

SEQ ID NO: 345113 - DNA, 450 bp, Homo sapiens
ttcaagcaattctcctgcctcagcctcccgagtagctgggattagaggcgcgtgctgccacgcctgtctaatttttgtagttttagtatagacggggtttcaccatgttggccaggctggtctttacctcctgacctcaggtgatctgccgcctgagcctccccaagtgtgggattacaggcatgagccactgtgcctggccagaaactgaattggagcttgatgtaggggaaccggtaaaggaaccactggccgacctaacaagaaaaggtgggtcattacattaaaagatcctccctagaggaaaatgctgatgtgtcctccaccaggggtgttttgtttgtttgtttttaacagaagtttagcctgagaaatccaccttggttttgaggctacaactcaacctgggaaaatcagatgtaggcatttagggttcagagggctggtatg

SEQ ID NO: 345114 - DNA, 2485 bp, Homo sapiens
ggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggaggaagagccactcatcctctccacagagtgtcctctggaaccggccacaaccctcagaggaccgcttgccttcccagcaggggctggcggaagccaggtcttccagctcctcttcctcaaaccattctgataactttttcaggatgggtagcagtcccctggaggtccccaaacccagatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagcca

SEQ ID NO: 345115 - DNA, 2515 bp, Homo sapiens
ggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggaggaagagccactcatcctctccacagagtgtcctctggaaccggccacaaccctcagaggaccgcttgccttcccagcaggggctggcggaagccaggtcttccagctcctcttcctcaaaccattctgataactttttcaggatgggtagcagtcccctggaggtccccaaacccagatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaggcctatagggagtcgtttaccaattaactggccgtcggtttaccgtcgtgctgggct

SEQ ID NO: 345116 - DNA, 2055 bp, Homo sapiens
caccatgttggccaggctggtctttacctcctgacctcaggtgatctgccgcctgagcctccccaagtgtgggattacaggcatgagccactgtgcctggccagaaactgaattggagcttgatgtaggggaaccggtaaaggaaccactggccgacctaacaagaaaaggtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttgatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagcca

SEQ ID NO: 345117 - DNA, 3189 bp, Homo sapiens
ggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggaggaagagccactcatcctctccacagagtgtcctctggaaccggccacaaccctcagaggaccgcttgccttcccagcaggggctggcggaagccaggtcttccagctcctcttcctcaaaccattctgataactttttcaggatgggtagcagtcccctggaggtccccaaacccagatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgtaagtgtcttgcttgagaaggcaggatgctcccctgcccatgggaaaagctggtgagcagtcaggagtgctgggtaggaatgaggctggcgctcaggagctggcctggcctcctgccctcccctctctcagctgctggacccgaggtatgaaggaggcctgtggctggtcaggaagtgcactggtttgtgtgttcactctgcagcctctaaaacccatccactggtgtctcaggtgcacccaaagggaaagctgctggactgtaactatagaagattctatttctgtataagcctttgcctgacatgagaatcgtttgaaggcagaacagtgggatagtgaaggtaggtgtatggtggaggccagagccagagtggtgctgggttagcccgaagctttgctcctgagcagaacctagggttacttgctgtctctacccgccttgtcttctgtttttgcctctgggcaggaataagaattggatggggattctagatcccacacctacaaaaccctgagtttccagcccttaacagtgtgtccacctgactggagcagctgcctctggggaaaccacctgcccctggcctgttctgccgcttcatggatgtcaggcaggagaaagcctctggtggccaggggagcaagccctgctcctcagctgtggtgcctgagggcctctcagcaagccttccataccatgggctggatgaatggcacatgctggggccttaccaccagcaccgcaatccagctcatcccccccacccctgttggcaggtgggaggcagggtgccttggggagttgggaagggaaagggggccctggatcctagctgagggcagtcaggagccagtcagaccttgaaattccaggatggcacaggtcctggctctgcagctgtgaagtcatcaaagagcttctgaggtcactgtgcctggcacagcctcctctgcagccagcccctaggctagaaacaagatcttagatgttcgaaggcttaaaaaaaaaaaaattgcaggccgggcatggtggctcacgcctgtagtcccagcacttagggaggccgaggcgggcggatcacctaaggttgggagttcgagaccaacctgaccaacatggagaaaccccgtctctactaaaaatacaaaattagctgggcgaggtggtgaatgcctattagtaatcccagctactcgggaggctgaggcaggagaatcgtttgaacctgggaagcggaggttgccgtgagtcgagatcatgccattgcactccagcctgggcaacaagagcgaaactctctcaaa

SEQ ID NO: 345118 - DNA, 2348 bp, Homo sapiens
ggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggaggaagagccactcatcctctccacagagtgtcctctggaaccggccacaaccctcagaggaccgcttgccttcccagcaggggctggcggaagccaggtcttccagctcctcttcctcaaaccattctgataactttttcaggatgggtagcagtcccctggaggtccccaaacccagatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagcca

SEQ ID NO: 345119 - DNA, 1898 bp, Homo sapiens
ggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggaggaagagccactcatcctctccacagagtgtcctctggaaccggccacaaccctcagaggaccgcttgccttcccagcaggggctggcggaagccaggtcttccagctcctcttcctcaaaccattctgataactttttcaggatgggtagcagtcccctggaggtccccaaacccaggtgaggagctccaaagcccttgctgttggaagtgcctagctttcccccttaataagactggagggtcgggggccagcacctgagctagggtctcaagatggggttcctaagcttgcaggcccagtatttggaggatgggttagtgtttggtaataaagcaagggctgatttgt

SEQ ID NO: 345120 - DNA, 1566 bp, Homo sapiens
attgcctccccgacccacactggctggactactgcccaggacagaagaggggggttggctgtgagtggggaggaggtggaagcggtagattcccagcacaaccttcttcctcccacccccaaaacctccatctgaagaaggcctgaggaagctgtcaggctgcctgcctgattcatcccttccctctgggcgtagccactgagtctgctgggctgatgcttctgaatacaaactatggcacctggaaggcactgcagagaaaggggggacctcagggctcccattccatcactcttgagtctaggtcataccctccacaatccccaagaggcccgtactgtctcttctgatgggactcctgggttctgtgttgcccaccctgcaaatctgcatgccagcaagtatgggtgacccggctggctgctgggtcaccttcatttgggtgctagccttgctgccttcctttggtgctgttgagattgtccttgccgtgttcactcccagcgcaggcatgccctggccccaggctgtggctccgattcactcttactgccatgctttgttctcattttttgcttccacagtaagtctgcacaaaatactgtcctcacagctgagcttacctggtgatctattcttttttctcggtcactacttgtccagcttttttttttagacttttggagacagtgattgacaacagaacctagcagccagggctgcgctagtcccctagccccctccagagcctgtgtcaggcatatgactgactgcatcctctcccctctctctcctctctgccccagatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagcca

SEQ ID NO: 345121 - DNA, 751 bp, Homo sapiens
gaaaatgtttcaacgtgcgcaagagttgcggcggcgggcagaggactaccacaaatgcaaaatccccccttctgcaagaaagcctctttgcaactgggtcagaatggtggcagcggagcatcgtcattcttcaggattgccctactggctctacctcacagctgaaactttaaaaaacaggatgggccgccagccacctcctccaactcaacaacattctataactgataactccctgagcctcaagacacctcctgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctgaaggaatgtctctttgtcccgcttccaccctctcctcttccaccctcagtggatgataatctcaagactcctcccttagctactcaggaggccgaggtggaaaaaccacccaaacccaagaggtggagggtggatgaggtggaacaatcaccgaaacccaagaggcggagggtggatgaggtggaacaatcgcccaagcccaagaggcagagggaggccgaggcacaacaattacccaaacccaagaggcggaggttgagtaagctgagaacacgccattgcactcaagcctgggcaataagaataaatccgtaggtcgaaaaa

SEQ ID NO: 345122 - DNA, 709 bp, Homo sapiens
gaaaatgtttcaacgtgcgcaagagttgcggcggcgggcagaggactaccacaaatgcaaaatccccccttctgcaagaaagcctctttgcaactgggtcagaatggtggcagcggagcatcgtcattcttcaggattgccctactggctctacctcacagctgaaactttaaaaaacaggatgggccgccagccacctcctccaactcaacaacattctataactgataactccctgagcctcaagacacctcctgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctgaaggaatgtctctttgtcccgcttccaccctctcctcttccaccctcagtggatgataatctcaagactcctcccttagctactcaggaggccgaggtggaaaaaccacccaaacccaagaggtggagggtggatgaggtggaacaatcgcccaagcccaagaggcagagggaggccgaggcacaacaattacccaaacccaagaggcggaggttgagtaagctgagaacacgccattgcactcaagcctgggcaataagaataaatccgtaggtcgaaaaa

SEQ ID NO: 345123 - DNA, 1705 bp, Homo sapiens
gtctatctactgaatataataagaacatgtttttcccaccttggtttggtttccttgtggcatagactgtagcaaggaatggaagttttccttccaatattcccagtgccagaacagcatctggcacacaaaggcattcaatatgagatggtaaattaatggacaaatgaatgatgaactaatgagtagaaaaatatataatgtatgtaaacacatttatctttcctgataagtacatgctctttgtttcaaatattttatttaattttataattcagctgttaaattattgaactctatatagcctctgtagcaatgaccaaagcctttgttgagaatcatttttagtcagagcactgtttttcctccattttcctccatgggtttctcttccagtaacaaatgtgatccaaagaaatgtaagcatagacatgaaaagggataatgccgcctttaaaactgttttctagtttgttgttagaagttataaaaatacacaggaacacagcattcacttgaaaataaatttttaggcattttaaatagattaaagcagaagaaagagtgagaaagtaaccattctaaattcttaaaaagagaatagcacctatgaaaatgaaataaagaatcatgaataacatcaggaagtcaggaaatgcagaccaacagtaaaagaatgctattaatgtccaaatgacttatttttattttgtgcagcaaaactcatcagatttatctgccaaacccaaattctcaaagcctttcaacccactgcaaaacaaaggccattatgcattttctcatactggagattcctccgacaacatcatgctaactcagtttgtctcaaatgaataaggcaaggaatcataaaatcaagaaaaaatttccagaacaacttgacatttagagacaaatgtcaatgaagaaattatgctcagtattcgatcgggttttctgatttaggggtctgggaataaaacaagaatgtctcagtggcttcattactgctcccttttgtcttcaattaaatgaaaagaagatttatttccatgtgatttgattcaaagaaagtgctccataaatgcagaagagtaggttttgttggaaatcgtgtcagttgtaccctgaccataaaatatggtttctattttcataaaacagcattattcacatggcatttccaataatctggattgaaggaagaaaattttatgaaatagctttagataaattaataggccacgttcattttcttgtcaaaaagttactggtggggggatggtgggaaaaagttattagtgcaaatttcctagagaaaaaaccatttctctttcaaattttccagttgaattttatgttcgcttttgcttcttaggttctatcacttaatattgaaagttaatcagaaataaaatgtaaacttctatttcagatagctttgtaaccatttatcagaaagtataataatgtgatatgatatataatgtggtatttttcagtttacaaggcacttccatctggtcctaaaccctgcaaacaaaagtgtcaaggcagacctagtgcagagatgagggcatgggggctcagagaggtaaagtgacttgccaaagattgtgaagccagttaagggaaattggggatttttaggacatttgtctcccagaccatttctacagccaataaaagccttgaaaattaccta

SEQ ID NO: 345124 - DNA, 1389 bp, Homo sapiens
atgtgtgttggcttaactggtccaatggaagcaaaccactcctggcttttgttgtccctgcactggctattgtggctgtgaacttcgttgtggtgctgctagttctcacaaagctctggaggccgactgttggggaaagactgagtcgggatgacaaggccaccatcatccgcgtggggaagagcctcctcattctgacccctctgctagggctcacctggggctttggaataggaacaatagtggacagccagaatctggcttggcatgttatttttgctttactcaatgcattccagggattttttatcttatgctttggaatactcttggacagtaagctgcgacaacttctgttcaacaagttgtctgccttaagttcttggaagcaaacagaaaagcaaaactcatcagatttatctgccaaacccaaattctcaaagcctttcaacccactgcaaaacaaaggccattatgcattttctcatactggagattcctccgacaacatcatgctaactcagtttgtctcaaatgaataaggcaaggaatcataaaatcaagaaaaaatttccagaacaacttgacatttagagacaaatgtcaatgaagaaattatgctcagtattcgatcgggttttctgatttaggggtctgggaataaaacaagaatgtctcagtggcttcattactgctcccttttgtcttcaattaaatgaaaagaagatttatttccatgtgatttgattcaaagaaagtgctccataaatgcagaagagtaggttttgttggaaatcgtgtcagttgtaccctgaccataaaatatggtttctattttcataaaacagcattattcacatggcatttccaataatctggattgaaggaagaaaattttatgaaatagctttagataaattaataggccacgttcattttcttgtcaaaaagttactggtggggggatggtgggaaaaagttattagtgcaaatttcctagagaaaaaaccatttctctttcaaattttccagttgaattttatgttcgcttttgcttcttaggttctatcacttaatattgaaagttaatcagaaataaaatgtaaacttctatttcagatagctttgtaaccatttatcagaaagtataataatgtgatatgatatataatgtggtatttttcagtttacaaggcacttccatctggtcctaaaccctgcaaacaaaagtgtcaaggcagacctagtgcagagatgagggcatgggggctcagagaggtaaagtgacttgccaaagattgtgaagccagttaagggaaattggggatttttaggacatttgtctcccagaccatttctacagccaataaaagccttgaaaattaccta

SEQ ID NO: 345125 - DNA, 538 bp, Homo sapiens
cccgtatctttatgtacagaaatgtccagtaggaaggagacaattgtcaattaagaccttctcttagaatcttagaattcataaattaaatgatcacaagcaataaataagggaacccaagttgtcatcaggcttcacctcactcccggtctagtaatgtacttaagagaataccaggttggtgtgctccagttctcctcttgaatgtcagcagtgatacacagtctggtgcaatgcaacagaacccactccaatgacatgaggcaattatgatctttttgttttaattggatagaatcctgcctctgaaacttcacttcatttgtttccaaagtctgatatttttctccaataaatgtccttattcttcatccttgaaacattaatactgtccaatctgtcctttaacataggaaccctgtccttttatgactgccttttgcaaacatagccccatgtcaatattgtgtatatatctgggttttaaaatctatgaggacatggatgagtcttacactccctagtattgcccacatga

SEQ ID NO: 345126 - DNA, 477 bp, Homo sapiens
agtctgctcggtggctcattatcaacaacaaaccagaagagggcttaaaggaacttacaaaagctgcacacaggaatggaatgaagaatgctgaagacatcctaaccatggaggttttgaaatccaccatgaagcaagaactggaggcagcacagaaaaagcattctctttgtgaattgctccgcatacccaacatatgtaaaagaatctgtttcctgtcctttgtgaggtctgctggagtttgctggaggtccactccagatcctgtttgcttgggtatcaccagcggaggttgcagaacagcaaagattcctgcctgctccttcctctggaagcttcattttagaggagcacctgcctgatgccagccagagctctcctgtatgaagtgtctgttgacccctgctgggaagtgtctcccagtcaggaggcacaggtgttagtgacccacttaaggaggcagtctatcccttagca

SEQ ID NO: 345127 - DNA, 2719 bp, Homo sapiens
tcccactgggggaaaaaaaaaaaactcctgcagctagctcagtgtctccccaaacagccacctagttttgcacttgaaacccagggccctggtagcattggcacacaagggaatctcctggtctgcgtgttgcaaaaactatgggaaaagcataatttctgggctggatagcacagtccctatggcttccttgggtaggtgaggaagttccctcgccctttggacttcctgggtgaggtgatgccccaccctgcttcagcttaccctcccgtgggctgcacccacccactgtctaaccagtcccagtgagatgaaccgggtacctcagttggaaatgcagaaatcactcaccttccgcattgctctcgctgggagctgcagaccagagctcttcctattcggccatcttgccagctgtctctatcgactacctcttattccaaaaaataaaaccataatgaagttagacaccattaaatatacataatataaaaataggttttcttattctaatctagatttgctacacaagaccatctacagaatgaatgccatgaatatacaatctgtacccaataagttgtacattttagtaaacattcctgattgtaagggtggcaaatggaaattttggcttcttagatctttactgtgagtttgactgacatcagtacatttttatttttaattgtatattttcattactgtgaatttttttgcagtgatttttgatgccatgtggctacattggttttagaatactaataaaatccattgcttttaaaataaataaataaaccccatagcacatcctccatacaacatctgttgtccctcaagatacaattgttaccactatcatctaaccattattttatgataactttaaaatatcaacttgcaagaaaatattccacaaaacacactctgcctttttactttaaagagtccttggctacctgggccaatattattctcatttgtaggatttaggttccacagattataatatgtgcctttttctgtgttccctgcagatttgcaagtaccatccctttttggggccttactcttgcaccttcagcactctgggaaacaatgttttcctgttgcagactctctttggtgcagtcaccctcctggccaattgtgttgcaccttgggcactgaatcacatgagccgtcgactaagccagatgcttctcatgttcctactggcaacctgccttctggccatcatatttgtgcctcaagaaatgcagaccctgcgtgtggttttggcaaccctgggtgtgggagctgcttctcttggcattacctgttctactgcccaagaaaatgaactaattccttccataatcaggtacaaaagtttatgtgtgctctgtcattctcaaaatggacctgtctcaaccaattgacacttaacaagggaaaaaaatccaagacaagttagttaaaaaacaatcaaatgtaatagtcataaaaacaacaaattacagcccaagtttatatcaagctgactttgttccagacgctgcattaagtcttttaatgcagtatcccatgtaccttctgaaccacctgaaaggttgatgttaaggaaaatagcattttgtaaatgataaaaatgtgtctaattcacttgtgaatctaaaataaattgctagcaaataagagaaaatttcaaaagcaagagtatgttatcacctccatgtgtttaagtgctcatccataatcacagcaaaatgataaatcacaaattatatgtatgatttttaacaacttttcctctgttgctgtttttactccaaggggaagagctactggaatcactggaaactttgctaatattgggggagccctggcttccctcatgatgatcctaagcatatattctcgacccctgccctggatcatctatggagtctttgccatcctctctggccttgttgtcctcctccttcctgaaaccaggaaccagcctcttcttgacagcatccaggatgtggaaaatgagggagtaaatagcctagctgcccctcagaggagctctgtgctataggtctgtgctgaggaaagcaaaacaccatttagggctaccatcccccaaaaaggcttagatctgggctattcccatgtagtcagtgcctttgcctttggtgtatcctcatcccttccacagtgacctcatacatcccctgagcctcactagatcacacagaccatctctgcccagcctgtccaggaggttaatttgtggtgaaaagaccaaaattaggtgacctctgcccttcctgccctggtatgacatgcatactcttgaaggtattctacaaacatgcagggatccaaacaccatcttctcatccctggggagccctcagcccagtgagtgtacctgttagctgtctgggattgccagtgcttacaggcctgactcccaggacactgaagaatttgtgagagactgtatagaaaataagagcccctcccacagatgagaagtccttttgtatcacatgtgagattcagtctatctaattttcacgggggaaaaaaagcgttggaaaaggggaaaagaagtgataagtaaaggaattgtttaagtaatgaagaatgagaaaaggttctaaaacttttctgtgcttctcttgccttttccaaaatccctttggtcaatgccatggtgtccaagtgtgagagttgaagctattca

SEQ ID NO: 345128 - DNA, 2267 bp, Homo sapiens
tcccactgggggaaaaaaaaaaaactcctgcagctagctcagtgtctccccaaacagccacctagttttgcacttgaaacccagggccctggtagcattggcacacaagggaatctcctggtctgcgtgttgcaaaaactatgggaaaagcataatttctgggctggatagcacagtccctatggcttccttgggtaggtgaggaagttccctcgccctttggacttcctgggtgaggtgatgccccaccctgcttcagcttaccctcccgtgggctgcacccacccactgtctaaccagtcccagtgagatgaaccgggtacctcagttggaaatgcagaaatcactcaccttccgcattgctctcgctgggagctgcagaccagagctcttcctattcggccatcttgccagctgtctctatcgactacctcttattccaaaaaataaaaccataatgaagttagacaccattaaatatacataatataaaaataggttttcttattctaatctagatttgctacacaagaccatctacagaatgaatgccatgaatatacaatctgtacccaataagttgtacattttagtaaacattcctgattgtaagggtggcaaatggaaattttggcttcttagatctttactgtgagtttgactgacatcagtacatttttatttttaattgtatattttcattactgtgaatttttttgcagtgatttttgatgccatgtggctacattggttttagaatactaataaaatccattgcttttaaaataaataaataaaccccatagcacatcctccatacaacatctgttgtccctcaagatacaattgttaccactatcatctaaccattattttatgataactttaaaatatcaacttgcaagaaaatattccacaaaacacactctgcctttttactttaaagagtccttggctacctgggccaatattattctcatttgtaggatttaggttccacagattataatatgtgcctttttctgtgttccctgcagatttgcaagtaccatccctttttggggccttactcttgcaccttcagcactctgggaaacaatgttttcctgttgcagactctctttggtgcagtcaccctcctggccaattgtgttgcaccttgggcactgaatcacatgagccgtcgactaagccagatgcttctcatgttcctactggcaacctgccttctggccatcatatttgtgcctcaagaaatgcagaccctgcgtgtggttttggcaaccctgggtgtgggagctgcttctcttggcattacctgttctactgcccaagaaaatgaactaattccttccataatcaggggaagagctactggaatcactggaaactttgctaatattgggggagccctggcttccctcatgatgatcctaagcatatattctcgacccctgccctggatcatctatggagtctttgccatcctctctggccttgttgtcctcctccttcctgaaaccaggaaccagcctcttcttgacagcatccaggatgtggaaaatgagggagtaaatagcctagctgcccctcagaggagctctgtgctataggtctgtgctgaggaaagcaaaacaccatttagggctaccatcccccaaaaaggcttagatctgggctattcccatgtagtcagtgcctttgcctttggtgtatcctcatcccttccacagtgacctcatacatcccctgagcctcactagatcacacagaccatctctgcccagcctgtccaggaggttaatttgtggtgaaaagaccaaaattaggtgacctctgcccttcctgccctggtatgacatgcatactcttgaaggtattctacaaacatgcagggatccaaacaccatcttctcatccctggggagccctcagcccagtgagtgtacctgttagctgtctgggattgccagtgcttacaggcctgactcccaggacactgaagaatttgtgagagactgtatagaaaataagagcccctcccacagatgagaagtccttttgtatcacatgtgagattcagtctatctaattttcacgggggaaaaaaagcgttggaaaaggggaaaagaagtgataagtaaaggaattgtttaagtaatgaagaatgagaaaaggttctaaaacttttctgtgcttctcttgccttttccaaaatccctttggtcaatgccatggtgtccaagtgtgagagttgaagctattca

SEQ ID NO: 345129 - DNA, 1911 bp, Homo sapiens
agtctgctcggtggctcattatcaacaacaaaccagaagagggcttaaaggaacttacaaaagctgcacacaggaatggaatgaagaatgctgaagacatcctaaccatggaggttttgaaatccaccatgaagcaagaactggaggcagcacagaaaaagcattctctttgtgaattgctccgcatacccaacatatgtaaaagaatctgtttcctgtcctttgtgagatttgcaagtaccatccctttttggggccttactcttgcaccttcagcactctgggaaacaatgttttcctgttgcagactctctttggtgcagtcaccctcctggccaattgtgttgcaccttgggcactgaatcacatgagccgtcgactaagccagatgcttctcatgttcctactggcaacctgccttctggccatcatatttgtgcctcaagaaatgcagaccctgcgtgtggttttggcaaccctgggtgtgggagctgcttctcttggcattacctgttctactgcccaagaaaatgaactaattccttccataatcaggtacaaaagtttatgtgtgctctgtcattctcaaaatggacctgtctcaaccaattgacacttaacaagggaaaaaaatccaagacaagttagttaaaaaacaatcaaatgtaatagtcataaaaacaacaaattacagcccaagtttatatcaagctgactttgttccagacgctgcattaagtcttttaatgcagtatcccatgtaccttctgaaccacctgaaaggttgatgttaaggaaaatagcattttgtaaatgataaaaatgtgtctaattcacttgtgaatctaaaataaattgctagcaaataagagaaaatttcaaaagcaagagtatgttatcacctccatgtgtttaagtgctcatccataatcacagcaaaatgataaatcacaaattatatgtatgatttttaacaacttttcctctgttgctgtttttactccaaggggaagagctactggaatcactggaaactttgctaatattgggggagccctggcttccctcatgatgatcctaagcatatattctcgacccctgccctggatcatctatggagtctttgccatcctctctggccttgttgtcctcctccttcctgaaaccaggaaccagcctcttcttgacagcatccaggatgtggaaaatgagggagtaaatagcctagctgcccctcagaggagctctgtgctataggtctgtgctgaggaaagcaaaacaccatttagggctaccatcccccaaaaaggcttagatctgggctattcccatgtagtcagtgcctttgcctttggtgtatcctcatcccttccacagtgacctcatacatcccctgagcctcactagatcacacagaccatctctgcccagcctgtccaggaggttaatttgtggtgaaaagaccaaaattaggtgacctctgcccttcctgccctggtatgacatgcatactcttgaaggtattctacaaacatgcagggatccaaacaccatcttctcatccctggggagccctcagcccagtgagtgtacctgttagctgtctgggattgccagtgcttacaggcctgactcccaggacactgaagaatttgtgagagactgtatagaaaataagagcccctcccacagatgagaagtccttttgtatcacatgtgagattcagtctatctaattttcacgggggaaaaaaagcgttggaaaaggggaaaagaagtgataagtaaaggaattgtttaagtaatgaagaatgagaaaaggttctaaaacttttctgtgcttctcttgccttttccaaaatccctttggtcaatgccatggtgtccaagtgtgagagttgaagctattca

SEQ ID NO: 345130 - DNA, 1772 bp, Homo sapiens
ataagtgagacaaaaaaaaaactctttagctctaatgttcccttttctgctatggcatacccctgatatatagtgagaattgaagcatcaactcagatccttttattcactatttaagtcacaatatgtaggccaatcacatttctcagctattagccactgcacattctttgcctctatgcagttttcctacagtacattttacccctggaaacacctccaaagcagtccttttcacttctaccttgggagatgctgattccttcagctcagatttcctgaggccctgtggtcttcctttctccagaaatgcagaccctgcgtgtggttttggcaaccctgggtgtgggagctgcttctcttggcattacctgttctactgcccaagaaaatgaactaattccttccataatcaggtacaaaagtttatgtgtgctctgtcattctcaaaatggacctgtctcaaccaattgacacttaacaagggaaaaaaatccaagacaagttagttaaaaaacaatcaaatgtaatagtcataaaaacaacaaattacagcccaagtttatatcaagctgactttgttccagacgctgcattaagtcttttaatgcagtatcccatgtaccttctgaaccacctgaaaggttgatgttaaggaaaatagcattttgtaaatgataaaaatgtgtctaattcacttgtgaatctaaaataaattgctagcaaataagagaaaatttcaaaagcaagagtatgttatcacctccatgtgtttaagtgctcatccataatcacagcaaaatgataaatcacaaattatatgtatgatttttaacaacttttcctctgttgctgtttttactccaaggggaagagctactggaatcactggaaactttgctaatattgggggagccctggcttccctcatgatgatcctaagcatatattctcgacccctgccctggatcatctatggagtctttgccatcctctctggccttgttgtcctcctccttcctgaaaccaggaaccagcctcttcttgacagcatccaggatgtggaaaatgagggagtaaatagcctagctgcccctcagaggagctctgtgctataggtctgtgctgaggaaagcaaaacaccatttagggctaccatcccccaaaaaggcttagatctgggctattcccatgtagtcagtgcctttgcctttggtgtatcctcatcccttccacagtgacctcatacatcccctgagcctcactagatcacacagaccatctctgcccagcctgtccaggaggttaatttgtggtgaaaagaccaaaattaggtgacctctgcccttcctgccctggtatgacatgcatactcttgaaggtattctacaaacatgcagggatccaaacaccatcttctcatccctggggagccctcagcccagtgagtgtacctgttagctgtctgggattgccagtgcttacaggcctgactcccaggacactgaagaatttgtgagagactgtatagaaaataagagcccctcccacagatgagaagtccttttgtatcacatgtgagattcagtctatctaattttcacgggggaaaaaaagcgttggaaaaggggaaaagaagtgataagtaaaggaattgtttaagtaatgaagaatgagaaaaggttctaaaacttttctgtgcttctcttgccttttccaaaatccctttggtcaatgccatggtgtccaagtgtgagagttgaagctattca

SEQ ID NO: 345131 - DNA, 1666 bp, Homo sapiens
tcccactgggggaaaaaaaaaaaactcctgcagctagctcagtgtctccccaaacagccacctagttttgcacttgaaacccagggccctggtagcattggcacacaagggaatctcctggtctgcgtgttgcaaaaactatgggaaaagcataatttctgggctggatagcacagtccctatggcttccttgggtaggtgaggaagttccctcgccctttggacttcctgggtgaggtgatgccccaccctgcttcagcttaccctcccgtgggctgcacccacccactgtctaaccagtcccagtgagatgaaccgggtacctcagttggaaatgcagaaatcactcaccttccgcattgctctcgctgggagctgcagaccagagctcttcctattcggccatcttgccagctgtctctatcgactacctcttattccaaaaaataaaaccataatgaagttagacaccattaaatatacataatataaaaataggttttcttattctaatctagatttgctacacaagaccatctacagaatgaatgccatgaatatacaatctgtacccaataagttgtacattttagtaaacattcctgattgtaagggtggcaaatggaaattttggcttcttagatctttactgtgagtttgactgacatcagtacatttttatttttaattgtatattttcattactgtgaatttttttgcagtgatttttgatgccatgtggctacattggttttagaatactaataaaatccattgcttttaaaataaataaataaaccccatagcacatcctccatacaacatctgttgtccctcaagatacaattgttaccactatcatctaaccattattttatgataactttaaaatatcaacttgcaagaaaatattccacaaaacacactctgcctttttactttaaagagtccttggctacctgggccaatattattctcatttgtaggatttaggttccacagattataatatgtgcctttttctgtgttccctgcagatttgcaagtaccatccctttttggggccttactcttgcaccttcagcactctgggaaacaatgttttcctgttgcagactctctttggtgcagtcaccctcctggccaattgtgttgcaccttgggcactgaatcacatgagccgtcgactaagccagatgcttctcatgttcctactggcaacctgccttctggccatcatatttgtgcctcaaggtgagaaaagttcacaggtggaagaaagcagaaggaaagggagaattgagttctcaggattccctgatagaaatctggggctttaggacagattttgccacacggaagttgctgggaaatgagtcaaagatgagtaagattggctcggatatatggttgtcttcagcacatttgagaagtagtaagaagttggtgccatttattcctgatagtttctctaggacagcaattgatcacttgccctttggccaatcaaactcttagtaagtattgaggtgctgggcctttgtatcccaatatgagaacacaatactgctatttcctctgtctgggctctttcttaccactacagcttctgtgacaaagtactccctaatcactacatatccactgtgtgccttgtattaggtca

SEQ ID NO: 345132 - DNA, 816 bp, Homo sapiens
gttcctactggcaacctgccttctggccatcatatttgtgcctcaaggtgagaaaagttcacaggtggaagaaagaaaatgtctttccctcttttctcagggattgccctggtcacacctatctgaagccagaaggaaagggagaattgagttctcaggattccctgatagaaatctggggctttaggacagattttgccacacggaagttgctgggaaatgagtcaaagatgagtaagattggctcggatatatggttgtcttcagcacatttgagaagtagtaagaagttggtgccatttattcctgatagtttctctaggacagcaattgatcacttgccctttggccaatcaaactcttagtaagtattgaggtgctgggcctttgtatcccaatatgagaacacaatactgctatttcctctgtctgggctctttcttaccactacagcttctgtgacaaagtactccctaatcactacatatccactgtgtgccttgtattaggtcaccataactgcaatcctggtttaggggagtcatcttgacttcaaagaaacaaaagtcccgtatctttatgtacagaaatgtccagtaggaaggagacaattgtcaattaagaccttctcttagaatcttagaattcataaattaaatgatcacaagcaataaataagggaacccaagttgtcatcaggcttcacctcactcccggtctagtaatgtacttaagagaataccaggttggtgtgctccagttctcctcttgaatgtcagcagtgatacacagtctggtgcaatgcaacagaaccca

SEQ ID NO: 345133 - DNA, 196 bp, Homo sapiens
ccaatgagaagaccacaccatccccagcagagcctacagaaaatggagacaggactcctttggccaatgagaagaccacgccatctctagcagagcctacagaaaatggacaaaggaccccatttgccaatgagaagaccacatcatcctcagcagagcctacagaacacgaagaaaggactccactggccaatga

SEQ ID NO: 345134 - DNA, 817 bp, Homo sapiens
tgttgtttacaaacttactcagtataaggtattttgctgtagcagcccaaatgtgcaaagacagaacccaatgggaagagagaacaggagttgaatacagagcaggctgagtgaagtaagacatgagtgtggggctggatcattcctagactgaacctgagcacactgaattctggtcatggcatccagggtatgtgtgggcatccatggatagttttgtctttcagaaacttggaccacctttcccaacttaatatatacaactaaaacatttctaatcagatctcattgcagtttttatttttaacttagcaacttgataataaagtttaactggaaggataaaattagccaaaataaaaatttgaaatataagcatataatattatgtatataatactagctatcaaatgtattataaagcaacaaccatgaaaacagcatggtacatgtataggaataggcaattagaccaggggaatatgtacaacagggagtctagaaaaaaatctgtgtatatatgataattaaatatatgacaaaaatagcatttcacatcagtgagaaaaggatggtttattacataaacagggaaaggttgtgaatttcagagaaaattcaaatttggttcctgtgcccgttttctggttccatacctgaaataaatccgaaatggattaaaggcttaaaaataaaaattaaaacaataaaagtgctagaaaaaaaataggtcctttttgagcatgacacaaaaaccagaagacagcaggaaaagacaacagtcctaactacgaaacaacacgcaacaataacaact

SEQ ID NO: 345135 - DNA, 563 bp, Homo sapiens
tttgagagccagtttcactcttgtcgccctcccaaagtgctgagattacagatgtgagccaccgcgcctggcctcacattgtatttctattggacgctgctgctctaggttactgagtttttcactctatttaaatgctacttccttacagaggccttcccagaccactcttcccttctgtctcattaccgtgctgtaatttctttgcactctttaacatctgaatttatttacctatttattgatttacttgctgttcacctgttttctccacaagaatgtaaactccatgagaccaaggataagatatatctttcttattcactgctatgttcccagtgcttagcatataaatatatttgtcagttatatatttttatctgtcaataatctcatcttgcttgttcactttacagccaacaaaataggcctagaaaagagcagggactttcaagatcacacagtgccagatcctacctcctaatacctaatccagtgctccttgctttggttacagttgatatgataaactgaggcacactaagacaggaataaggtgtgca

SEQ ID NO: 345136 - DNA, 770 bp, Homo sapiens
gtacaagaatctcttgctaataagcccagcctttttccttttagagtggctgatgcttgaagaactatggaacgttggggtgtattcctttgctctcagatacttgaggagatcaccacataaattcttagagttctgggtttagctgtagtgtttagtctagtgtcgaagcagaggttgggcaaatatacactactgtaaatactttcttgtgctatagctgttaagcatgttctagtttaaacagttgtcagtgattagcgattttgatgttccgttttaagattttgtaatggtctagacgaacatgaacaaaaccaaaagaccgtttcaagttcagcagatagtaggagctaatcttttctgtggtttggtttggtcgcctgccttaggttggtttactagtctgtgactttctgagttgctttatcttgtgctaacttctatcagatacaatctccatattgattcctgtttattcttgcctggatgatctattccatttagatagctagaacattcagtagctctcttgagggaatcccacctgtgggttgcagaagggtaacctacagatgcccgattgtcctttttccctggattaaaaagaaaccatttgccatttttctggcttcttagaaaaataaatgatatatgaaatgtttgcagcagcagaactttttcctgcccaaaggtttaagattccatggacacatctcctggtctagcatgctattgctctttctcatcaactttccatctctcctcac

SEQ ID NO: 345137 - DNA, 262 bp, Homo sapiens
ttgatatgggtggcagtatatttaccttaattcctgccattgttccacaagctctccctcggaatcaacaaactactcagttgacagatatggataatacccgtcacatttcccatgtcccagcacacaacggtcacctttggacctttagccaagaaacattcccttcctaggagacactacattcactaatttcataaggaaaaatctcccgtgtaaacagaatttccagatcaaacactctcctgatggtctcttcctt

SEQ ID NO: 345138 - DNA, 1165 bp, Homo sapiens
ggcacgagccacgattcagtcccctggactgtagataaagaccctttcttgccaggtgctgagacaaccacactatgagaggcactccaggagacgctgatggtggaggaagggccgtctatcaatcaatgtgtaaacctattactgggactattaatgatttgaatcagcaagtgtggacccttcagggtcagaaccttgtggcagttccacgaagtgacagtgtgaccccagtcactgttgctgttatcacatgcaagtatccagaggctcttgagcaaggcagaggggatcccatttatttgggaatccagaatccagaaatgtgtttgtattgtgagaaggttggagaacagcccacattgcagctaaaagagcagaagatcatggatctgtatggccaacccgagcccgtgaaacccttccttttctaccgtgccaagactggtaggacctccacccttgagtctgtggccttcccggactggttcattgcctcctccaagagagaccagcccatcattctgacttcagaacttgggaagtcatacaacactgcctttgaattaaatataaatgactgaactcagcctagaggtggcagcttggtctttgtcttaaagtttctggttcccaatgtgttttcgtctacattttcttagtgtcattttcacgctggtgctgagacaggagcaaggctgctgttatcatctcattttataatgaagaagaagcaattacttcatagcaactgaagaacaggatgtggcctcagaagcaggagagctgggtggtataaggctgtcctctcaagctggtgctgtgtaggccacaaggcatctgcatgagtgactttaagactcaaagaccaaacactgagctttcttctaggggtgggtatgaagatgcttcagagctcatgcgcgttacccacgatggcatgactagcacagagctgatctctgtttctgttttgctttattccctcttgggatgatatcatccagtctttatatgttgccaatatacctcattgtgtgtaatagaaccttcttagcattaagaccttgtaaacaaaaataattcttgtgttaagttaaatcatttttgtcctaattgtaatgtgtaatcttaaagttaaataaactttgtgtatttatataat

SEQ ID NO: 345139 - DNA, 436 bp, Homo sapiens
tcgatctagcggatccttaacgcgagaggacactacacactatctggatctccaggtggaggaaaattctacctgttctccctttgctgatgcttccttcaagtttcgtcccagatgtggctcagaacttctgcccagagcttcgtgtcaggccaggtttcccagcttcctgtctagaatgagggcctgtggagctagtgtcctggaaggtcttggaaacatctcttgtggttcatctgttctatgtctgctttcacaggtgctgagacaaccacactatgagaggcactccaggagacgctgatggtggaggaagggccgtctatcaatcaagtgaatcaaatgctgttgggatggggctctggaggcttaggccctctgcactcacgctatctcctgtggaagccccagccttctctgctcctctctgcgttac

SEQ ID NO: 345140 - DNA, 1208 bp, Homo sapiens
ggcacgagccacgattcagtcccctggactgtagataaagaccctttcttgccaggtgctgagacaaccacactatgagaggcactccaggagacgctgatggtggaggaagggccgtctatcaatcaatgtgtaaacctattactgggactattaatgatttgaatcagcaagtgtggacccttcagggtcagaaccttgtggcagttccacgaagtgacagtgtgaccccagtcactgttgctgttatcacatgcaagtatccagaggctcttgagcaaggcagaggggatcccatttatttgggaatccagaatccagaaatgtgtttgtattgtgagaaggttggagaacagcccacattgcagctaaaagagcagaagatcatggatctgtatggccaacccgagcccgtgaaacccttccttttctaccgtgccaagactggtaggacctccacccttgagtctgtggccttcccggactggttcattgcctcctccaagagagaccagcccatcattctgacttcagaacttgggaagtcatacaacactgcctttgaattaaatataaatgactgaactcagcctagaggtggcagcttggtctttgtcttaaagtttctggttcccaatgtgttttcgtctacattttcttagtgtcattttcacgctggtgctgagacaggagcaaggctgctgttatcatctcattttataatgaagaagaagcaattacttcatagcaactgaagaacaggatgtggcctcagaagcaggagagctgggtggtataaggctgtcctctcaagctggtgctgtgtaggccacaaggcatctgcatgagtgactttaagactcaaagaccaaacactgagctttcttctaggggtgggtatgaagatgcttcagagctcatgcgcgttacccacgatggcatgactagcacagagctgatctctgtttctgttttgctttattccctcttgggatgatatcatccagtctttatatgttgccaatatacctcattgtgtgtaatagaaccttcttagcattaagaccttgtaaacaaaaataattcttgtgttaagttaaatcatttttgtcctaattgtaatgtgtaatcttaaagttaaataaactttgtgtatttatataataataaagctaaaactgatataaaataaagaaagagtaaactga

SEQ ID NO: 345141 - DNA, 581 bp, Homo sapiens
tttaaaccttcttttatctctctttttctcaatcacctcagctttattaacatataataaatagtgtatgtatgtataatgtacaacatgatgttttgatacatgaatacatgatgaaattgttaaatcgatctagttaacatatccataacatcacttactgatatggtttcgctctgtgtccccatgcagatctcaccttgaactgggttcctataatccccaagtgtcatgggagggacgcagtgggaggtaatttaataatggggctggttatcctcatgttgttcctgtgatagtggatgagttctcacaagatctgatggttttataagggactttccccccttttgctcagcacttctccttcctgctgctatgtgaagaagagtgtattttcttccccttctgccatgattgtaagttttctaaggcctcctcagctatgtcgaactgtaagtcaattaaacctctttcctttataaattacccagtcttggacagttatttatagtagtgtgagaacagactaacacaataaattggtaccaggtagtgtggtgctgctgtaaagatacttg

SEQ ID NO: 345142 - DNA, 329 bp, Homo sapiens
agggaaaagcaagtttaagagagcatctccaagggactaatatgcaagaggactccagcccagtaatgccccattccccacttaggggtgggcatgtgttgacttcactgcagctccaaggaatctctggccaatccaatcactgggcacatgtctggaccacttagtcacatggcttcacttcctccatttatgtttccaccatccacactccagccaatggcttcccacccttcacagtcgctgcatattgtttaactgcttctgactgaaaaatattcttcctctcacctttaaaaaaatacagctctccatctctccttaaaaaa

SEQ ID NO: 345143 - DNA, 939 bp, Homo sapiens
ccgcctcatcctcccaaaatgctgggattacaggtgttagccaccgtgccaagcctctttatcttccattaagtagttcatttctgctatcttgttttgcatgtccaacagctctttctgtaccccgtttcttttgatggcatcctgttgtttcagggacacaatatcttacacctctgaggctaatagtttattttttccttttggaattttctccctgaagtgtttcctcccaattgctttttgcttgtgaaggtctttgtttgtttgagacagtctcgctctgccgcccaggctggagtgcaatggcgccatctcagctctcactgcagcctccacctcccaggttcaatcgattctcctgcctcagcctccagagtagctgggattacaggtgtgtgccaccacgccctctaagcttgtgtaggtttctatcttccaggctgaaggtttttctcagatgtcaggtcacccttgagtatctgctcatattaggagtggggcagggctggagccatgaggcagatcggaagctctgagcacaagggtggtacttccttggaggagatcagggtgggtgggctcttgcttttatggaatgccccgaggtcagttttagatccctttccagtccttcctgggaagcctgtctgtggagcatctgtatgcacactgggttttctggtttcagtacatttcttgtctgtgtgtggtgacctctcagaacccctcagacttcggctgcagtgggagaggaccagttgctgagtggcagggatcttggcagtcacctggaagactggaaggggacatgaagggggcttctgggtggggacaacgtcctgggtgctacccacacagacttgttcacaccatgaatgtatcaagccatactctacctctgcagaaataaattgaggctggagcctagctcctgga

SEQ ID NO: 345144 - DNA, 191 bp, Homo sapiens
actccatctcaaaaaaataaataaataaaataaaaataaatacatacaaatttaatttcagataacaaaccgtacaccatatttgaaattatgggtgttcctttgctcagaagaaacactttgtcgcctttttctgcctctaattacatctcaccccacctcccatatttctcttaatcatttttactatg

SEQ ID NO: 345145 - DNA, 607 bp, Homo sapiens
ataggaccaacgaagaaaccctttatcctccaggacagtgtgaagggaaagactcaccttagttgatccaatggggagaggaggagcaggacataaagcctctgtgctggtttgagccaagttggaaagtttctaactaaagaaagtcccagagatcataggtcttgaatagaaaagggaatagattttagaatgctaaaattgtgaatgattaatttgggctcattccccaaattctctggatttcataaagcctcagttcttctcaacctgagggtgctgcttactgtctctggagagacagaaatgcagcttcagaggccaggatggtggctcacacctgtaatcccagcactttgggaggcagaggtgggaggatcaactgaggttgggcattcgagaccagcctgaccaacatggagagaaaccctgtttctactaaaaatataaaattagccaggcacggtggcacatacctgtaaccccagctccttggggggctgaggcaggagaatcacttgaacccgggagacagaggttgcggtgagccgagattgcaccactgcactcaggcctggcaacaagagcaaagctcagtctcaaaaaa

SEQ ID NO: 345146 - DNA, 687 bp, Homo sapiens
ctgcctcagcctcccaaagtgctgggattacaggcttgagccaccgttcccagcctagtaattaattttagattgtcattttgctgagcacattctaaagactcatccatgttgcaagtattgttggaagtatctgcagttcattcctgttcattactgagtggtatctcactgtatgaatttgccacaatgtgtttatcaatgtattgttgggcattggttatttccagtttttggctattatgagtaaagttgatatgaacattcaagaacaagctgcaggacaattctccaggtcaccttagactcgcccagttcttccctctttctcacgtgtgttctcaacaataactgtagaatgtgctgggaatgcaacatcctgcgataaagagggactgacaagaacagctcacaggctctctctgttcctgtctgcctctgagaaacaagatgtccatcaacacttttgcccagcgtgtcatgtggtccccagggtattaaatccagtgtgggatgctttctagtgtccctcagctgcagtgcaagtgggacacatgccccacttgtgagaatccatccaccctcggtagctttcttgagccttgggagattggctcacaatgaattccgggcttctgttgtgcctcagggccaatctgtaagtaataaacccacttcatgtaactt

SEQ ID NO: 345147 - DNA, 115 bp, Homo sapiens
aatgagtccattactaaaagaaagctgcatatctttaaaatcttttaaatggtcttatttattattaacagacaagtcatggcattaatttctttacaaagtacacatttcctgt

SEQ ID NO: 345148 - DNA, 110 bp, Homo sapiens
tcaattggggcttcaacattgtgagatcaaaaggagatgaaccatgtagttgcggcatctttcattcccctcattttacctatgccttggaagtgccctgggggctccac

SEQ ID NO: 345149 - DNA, 364 bp, Homo sapiens
atacttgcatatatactatctcatgggatccaagcccacatatacaaacccagctcctgccagcctgttagtaggccctgaagctccttcagagtatcatccctgtatttcttttaacaggctcagtactcccctgtctgggttatgctgaagcttaatcctagttatttgtctgatatctagaagaagtgggttctcagagggtttgttgtcttgcaatatcatagcctctgcattatcttcaaagaagaaatgagcacaggtttttaacaagtaaggatgagattcttctggaggcctagagtgcttaggggatcctggggattcaatatttttgagtgggtcaacccagatgtccccacac

SEQ ID NO: 345150 - DNA, 421 bp, Homo sapiens
acagaaaacatatgttgatcccaaacatgcaatgacatccatataaaccttgcaaaatgatggctgtgatgacacccagtgatggtctttctcaactctctgtacctcatctcactcatcagagactttggagcctcagttgccttgcaatgctgtttcaggctgtacttattctttctgcaccacaaatgtcatgccttctcaagtgtttttatgccctggacccattgcatccagtgatgtcagaggaattctcagctcaatatcgtcacatgatggatcagagatacagaactagaattcatgagggatacatatctcaagtgaaaggtgcatatctacggattgtccacaagaaaccaatcagttatgcaaaatcttttccaaaggaaatgggaaattaaggaaaaaagtgaataaa

SEQ ID NO: 345151 - DNA, 347 bp, Homo sapiens
tccagcctgggcaacagcgagactccatctcaggaaaaaaaaaaaaaaagatcaccaagtctttgcagtgttcaacactcattgacaacttactagcaactagcccttagtccttggtcccgaagggcccatgggctggcatgttgcctacacagaggtccaaggagagggcttgttttctcaggccagttcttagcccctaaggaggccctccaaggcctgccagtcttgcagtccaggggtgggtaggaaggctgggtctccagtcagaactggttgattgaggggagtcagcctcctgggctgccacagaagtctgaccagcctggcagtaggtggcctcagga

SEQ ID NO: 345152 - DNA, 665 bp, Homo sapiens
gtatgatctagacgatccgcgggcttgtttcctgcacttcagcttagaagaaatccacagaaacttctcttcacactaaccatatgacatgctgttaacccctctttactggagctggtgccaatcttggctcaagccaaaggggatacgaattcttaacctgagagtttcaggcactcatctcctgccagttcagcaagaccctagttcaagaaagaaactacagccctcagaatcatgccaggtatgaacctcagaggctggagagagaaagaagcctcagcatgaaccaaaacatgaagaagaaccaaagatagctctatggcattattgttgcaagatagatgtccttcctatattccctgcactccactgccagtcttgctaaagtaaaccccatacatgaaaagcagaaatggaaggtgagcttatattattctatttctggagcttgctacctggtgttcactttataattaatcactataaatatctgttttgtggacctttctgtgtttcatattacagtttttaaatttaaaataataaatcacaggtaacgtcgtgctctgagttgcccacgtatggctgagtagagtcagggacttggaagctgaagaaatggcactgcaataggtaccctatgacatcaacagattatttag

SEQ ID NO: 345153 - DNA, 412 bp, Homo sapiens
acaatcagtatgttctactgacctgtggctaagtttgccaaagcattagagagtagtggaaggggttcctaaagccatattccacctggcatggcatgtacactaaatgaacattttctcacacaaaatgtactaccggttttcaaatatacatatgtatgactagtcaagcactaatttatgtagaagtgccactgaattcaaaagtctgcaagaggagcagatgagaaaaataatgtaagaaaagcacctggcatagaataatccttcaataaagagtatcactatgagaatataaataataatgcttcccaatcagcatttggttccatatgagggttaacaaagtgtattggtaacaaaggtaacacagccaccttactccaaggactagggccgctgtatctaggcc

SEQ ID NO: 345154 - DNA, 551 bp, Homo sapiens
ccagacttttatcagctagatgccattgcagggagtgtttgcccaccttctacttcccaatatctttattgcccttcactgttacattggattcccattttccttcttgaatgaaatctcaaagagttgataattatgcactattttgctatttccaagtggctggggcatgcccaaagcctctaatccaccattgttttattaggaattctgggttttttttgttttttctctttcagaagtttttgtttttgttttttcttagtcagatggtgccatcacagtttccggaatgaagcaatagacaaatgaaaagccttccaatttgagccaggtgtctgttgtttaagcacttgctagttcttggtagctcatgctagttttcctgttttctctggagggaagaccagaaggtgatgctgggaatcagtccccagtgctctccttatgtggactattgtgaggcacatacataccctcactgcctctgctcttagaggggcagacttcaaaacaaaagggatgagtgtgggggacatgtgcgtgggggt

SEQ ID NO: 345155 - DNA, 486 bp, Homo sapiens
ctgaaacggagaggggaaataatgtgcagtctcattctagagtctggaagggcccagaacagtttttaaaaattattcaactaatgtgtaaataagataaccccaccctctctctaattcccaactcttatgtagaggttagaactggggcaattggtagggatggggacagaataaagttgtccatttgagcagtatttgctaacctgaacagcttcaaatgaatgatatccattagaaaatgatatccattagaaaatgataccatgagtggaatagcttcttatatttgatgaatcgtcatctggtagttgctgtagttcactcacttgtcattctttcattcatttatcaaatatttattttgattttgccatgtgctcagccacaagagaagaccaggattatagatattatagtaacatgtctttggtggcctccactgaaaacacaagtggacgcggccgcgaatttagtagtagtagt

SEQ ID NO: 345156 - DNA, 432 bp, Homo sapiens
ctgaaacggagaggggaaataatgtgcagtctcattctagagtctggaagggcccagaacagtttttaaaaattattcaactaatgtgtaaataagataaccccaccctctctctaattcccaactcttatgtagaggttagaactggggcaattggtagggatggggacagaataaagttgtccatttgagcagtatttgctaacctgaacagcttcaaatgaatgatatccattagaaaatgatatccattagaattgctgtagttcactcacttgtcattctttcattcatttatcaaatatttattttgattttgccatgtgctcagccacaagagaagaccaggattatagatattatagtaacatgtctttggtggcctccactgaaaacacaagtggacgcggccgcgaatttagtagtagtagt

SEQ ID NO: 345157 - DNA, 851 bp, Homo sapiens
aaataaataaataaataaataaataaataaataaataaatagaaaaggaaaaagaaagaaaaagcttctctgtttcagagtagggcatcctcatacagcaagtggaggaacgtactgtctttaagtttttcttatgtagggatcttttctatgtaaagaataaactacctgtgcctatgtgcatgtgggctgacagcatcacaaaatttattactctgttgatttaaagaaaactatcctttacattttagcacccaagtgcattaaaacataactataattatcttgaaagcacatattgttataggtattgggacatcaggacattctattgttgtgggagtgtaaggatacttgcaggcatcttcaggctgttttcttcatgggaaacattttgtgatcatgggttgtgactgacaaggagtgtttcttgttagtgtcaagatggagctgaacttaaattggtgttactctggctcccctaggcacctgcttccctaacacttgtataggcaaaaggcaaataaatgtaacaggattatgttttccatagaaggctgatgtatgagatacaacaattttttttttttttggagacagtatcttgctctgtgacccagcctagagcagtggtgcgatgatggcttactgcagccttgacctccccagctcaagcacctccgcctctcaagtagctaagactacaattgcccaccagcacacctgtcgaaggacggtgttctggccaaagacatcagctaagaaaggaaactgggtcctacggcttggactttccagccctaagagacccgcaagacaaaacacctggttcttgccagcctctagagaat

SEQ ID NO: 345158 - DNA, 318 bp, Homo sapiens
attaactctgactcctgacagtaactctacagaggttctgctgttacccagttttacatagaaacatggccagcggacgcagttagaaaatggcaaagtggggattagaaactaggcagtttgactccagagtctgtgcccctgtccacttggctccactgctggggaagaggcctctgaagcagcaggaccatctgctgtgccgtgtgtagtggtactctatcttcctggtgtgatgttgtgttctactttgcattttcatgtctttccttatacaggtctcaaaatcatttacttttttttttttttttttgagac

SEQ ID NO: 345159 - DNA, 687 bp, Homo sapiens
aaccctgaagtcatgcatcctctgttgtatgggagtaagtggattgttatgaaaatattcagtgcaataaactgaatgtttatgtctcaccaaagttcttatgttgaaatcctaacccccattgtaatgttattagggggtcaggcctttggaaggtgattagttcttgaggatggaaacctcataaatgtaattagtgcccttataaaagaaccccaaaaagctccctccctcatcccaccatgtgaaaacacagcaagaaggtgacatctgcaacccaaaagagggccttcagcagaacctgaccaagctgaaccgtgatcttggacttccagcctccggaactgtaagaaataagtgcttgttgtacaagccactgtggtattctgttaaagcagcacaaattgaccaagacgctcaacctacaccaatgatcctggaggctggcaaatgaatagcactgaatgacagtataatagtgccgacagtaataaaagaacaaaagatgtatgttattatgaaattatgaagaatattattgacttcagtattgctacctccccttggatataatgaggtcacacataacagaacacagatatagataagccagtaaaaatactctgacaaagttccaggaaatggctttttcgaaacatgggacagctgccaaacaaaaaagaaatt

SEQ ID NO: 345160 - DNA, 177 bp, Homo sapiens
tcaggaaaaacaatgcctgtctttgtctgactcaaaaagcatgctgaatggacttttcatcctgtggctgtgatcagttcctaaagcagaggaatctgcagcctaatgacacatcaggaattgatggaaccccagcggacagcttctatgaggtgtgtgggtggcggatgtgaaatc

SEQ ID NO: 345161 - DNA, 754 bp, Homo sapiens
tcaggaaaaacaatgcctgtctttgtctgactcaaaaagcatgctgaatggacttttcatcctgtggctgtgatcagttcctaaagcagaggaatctgcagcctaatgacacatcaggaattgatggaaccccagcggacagcttctatgaggagattaggactctcagaagagacccagaggcgtggccacacagagaaaaagatcatgtggggacacagtgaaaaggcagccatcataagccacagagagaggactcagaagaaaccaactctgctgacaccttcatcttgaacttctagcctctagaactgtgaaaaaacaaatttctgttgttaagacacccggtctgtggtattttgttaagacagccctagcaaactaacacaattttgtacactaaataaagtccaattcaattttaattttatagaaactgaaacaaataatttaaagatttacttagtaaattacttcagattgggatcaaatgtgtacatgaattatgaaaatgtaagaaatggatatttaaataagtataccagaacataaaaattccagtgcctggttttttttttttttttgaaagccacttatcccaacaataaaactgatgctcaaaataaaaaactggcctcgttggcctcaaggggggagcttttggggccgcttccttttgggggggggtaatttattgatccttggttattggaattgttgggctccgggcgtttgggtttggggaagcgggttt

SEQ ID NO: 345162 - DNA, 625 bp, Homo sapiens
tcaggaaaaacaatgcctgtctttgtctgactcaaaaagcatgctgaatggacttttcatcctgtggctgtgatcagttcctaaagcagaggaatctgcagcctaatgacacatcaggaattgatggaaccccagcggacagcttctatgaggagattaggactctcagaagagacccagaggcgtggccacacagagaaaaagatcatgtggggacacagtgaaaaggcagccatcataagccacagagagaggactcagaagaaaccaactctgctgacaccttcatcttgaacttctagcctctagaactgtgaaaaaacaaatttctgttgttaagacacccggtctgtggtattttgttaagacagccctagcaaactaacacaattttgtacactaaataaagtccaattcaattttaattttatagaaactgaaacaaataatttaaagatttacttagtaaattacttcagattgggatcaaatgtgtacatgaattatgaaaatgtaagaaatggatatttaaataagtataccagaacataaaaattccagtgcctggttttttttttttttttgaaagccacttatcccaacaataaaactgatgctcaaaata

SEQ ID NO: 345163 - DNA, 928 bp, Homo sapiens
tcaggaaaaacaatgcctgtctttgtctgactcaaaaagcatgctgaatggacttttcatcctgtggctgtgatcagttcctaaagcagaggaatctgcagcctaatgacacatcaggaattgatggaaccccagcggacagcttctatgaggagattaggactctcagaagagacccagaggcgtggccacacagagaaaaagatcatgtggggacacagtgaaaaggcagccatcataagccacagagagaggactcagaagaaaccaactctgctgacaccttcatcttgaacttctagcctctagaactgtgaaaaaacaaatttctgttgttaagacacccggtctgtggtattttgttaagacagccctagcaaactaacacaattttgtacactaaataaagtccaattcaattttaattttatagaaactgaaacaaataatttaaagatttacttagtaaattacttcagattgggatcaaatgtgtacatgaattatgaaaatgtaagaaatggatatttaaataagtataccagaacataaaaattccagtgcctggttttttttttttttttgaaagccacttatcccaacaataaaactgatgctcaaaatattttgggacctatctttatactctgttaattatgcactcaagaaaataagtgtgactatattacagccactccatttttgtttgtttgtttatgttattcagcttagtcatttaaacaattttcactgcaatcgctacaagttttgttgtttcttagtattgaatccactctcaagggatgatgactttccaccatgaactttgaaaacagttccaaagaaaacttcaaaaaggttttgagtgcttaggatcaatgtcaatccagtgggtaccttgattttttacctcctacagtcgaagctt

SEQ ID NO: 345164 - DNA, 406 bp, Homo sapiens
tctcttgcttggatccttttctaagggggactggtgaatatctctggacccaggaccaggtgatgtggctctgcagcctgggttctgcccacatattaaattgtgacatatacttaaagaagcacctatatgatatgactgtcttcttctgcctgagccctgcctactggtgacattggaccatatctctgagcccctgacctaagtgatgggactctcttctgtctgggcctttacaatgggaagattgtgacatgttgatgagcccagcacttcggtattgtgactctcgtcttgttgctgaacaatgcccgtgaacaggacttttgccgtatttcagagcccagcacccagttgatgttactcttctgcataaacaggtcatgcataaagagggaattatggt

SEQ ID NO: 345165 - DNA, 1259 bp, Homo sapiens
ccgctgtccacccagccaacccagatcacctctggcctttcctgtgccttccgggcttgctgctggggggaaacctccagagtcccactttggtaataagaggtctctgccctttctccctgggcagcaggatgttgtaatggaaaatgagtggacctaggcttcagagactctggtcccctggctttgaatccccttctgccactatcccagtcaaggactgattcagaacctaattttcttcatttggaaaataatgttctgatagaggtgacttttgtggtacttgagaccatatgattcctatcattaccaaccaatattttccgattgtttttgccccatgtgacttctctgtgattcctcctggcaaggaagttttacaggaaagcagggccacttttgggatcctgtgctgggctggatcattttcctggactggacctagtccacaagctgctggcatctgtttctcctcatggatctctctctgcccttgtatacacctgcattcaaaaatgatcacgggctgcctgtgctctggtcatcaataacgcagggagaggaattgctgaaagccgtttcccgtgtttggagggttcacacctgtccctttcaaatgctggcgctttcacacactccttctctcctgccagcaccttctggtctcaggagcattgcaggatgttgtgtgagtgagtgatgggagacactttagtatggcttttttcagcttagcctcctgttatcagagagcagtctctttcagtgtcaaggtttgagtactagatggtggagaaagcctgtgtgaattatttttaatgaataagtgtgatgatgggtggcatacagtcactgccttaagattttcaaagagaagcagccttttggaggtggtgggcctgggcaggtctttcaaggagtgggatgtgatgggcagtagaaaggtattccagggaggggtagcaacatgagaaggtctttcaaggattgggatgtgatgggcagtagaaaggtattccagggaggggtagcagcatgagaaggtctttgagtctgggatgagcaagagtgtctagtcccaccagggagacagatgtgtaggcaagtaatgacagcatggagggatggctgctggggtgatccttggctcccagcacggcgaggtggacatctatgggaggggccctgagaggtctcttgagctgtttctgccagttgcacatctgctcagttgcctgttaagactcttaagacag

SEQ ID NO: 345166 - DNA, 505 bp, Homo sapiens
tgagtgaccatgagtgaaatcagctgaagtgctcagaaaaatactcacttctggtttcctaacaggactcattcaatcatttagtcattcaacaaacacttctggagcacctattgaacatcaggatttgtgccggctgctgtcagtccacagttctcaaaaggtgctctcagaagtttgggggcggggagagtgggtggtggtgatacctgggatgacatggagttctttttttgtttaatttaaccacttagaaaaaagttctgcttaaaaaaacaaaggattgcaatcactatagtagaaggatatagaaatgaaaacggtcgatttcccatgcccaagagtttataacttggttctagtcatggccaccatttatttagcatgtactatgggcaaggcaccacagaggctatttttattttattttattttattttattttattttattttatttattttattttattttactttgagatagagtctcgcattgtcgccca

SEQ ID NO: 345167 - DNA, 654 bp, Homo sapiens
agtcgggcccatccacccataattttagtgatgaggggcagtaaccatgctgcatattgtgtttaggtcatgactttgtgaaaactacaaagagtgctagaagaatatagaagcatgctgcatattgtgtttaggtcatgactttgtgaaaactacaaagagtgctagaagaatatagaaacctggccaggtacacagcaaaaaatgaaaaccaaggttacaggctaacccatgcataaaaatgagagcctgttgctacctaattacaattccttctccttttcctttgtaaatgcccacaatttgaaggcagagagagacacccacaagagcacagccccaccatcgggaacaaaaacttgctaacaagtaataacatttagatttctgaactaaaagcatagtttttaccatatggaaggaaaaaaatgtagtaggaaacactgaccacaatacttagtacaagagccaggcaactacaaagctcaagatctgattgttttcagcgtccaaatataccagtggattttaatgtatttataaacttactttgttagtataatgaagaatccctgcatacctacattattttttaaagtggattggggaaagtgatcattctgtaagcaggatatagtgactccttctggaaga

SEQ ID NO: 345168 - DNA, 2722 bp, Homo sapiens
ggaaagcggaagtgtgggagggtctgcggggcgggctcaggaggtccgcgggaggatggagcagtgagcgggtctgggcggctgctggcagcgccatggagacggtacagctgaggaacccgccgcgccggcagctgaaaaagttggatgaagatagtttaaccaaacaaccagaagaagtatttgatgtcttagagaaacttggagaagggtcctatggcagcgtatacaaagctattcataaagagaccggccagattgttgctattaagcaagttcctgtggaatcagacctccaggagataatcaaagaaatctctataatgcagcaatgtgacagccctcatgtagtcaaatattatggcagttattttaagaacacagacttatggatcgttatggagtactgtggggctggttctgtatctgatatcattcgattacgaaataaaacgttaacagaagatgaaatagctacaatattacaatcaactcttaagggacttgaataccttcattttatgagaaaaatacaccgagatatcaaggcaggaaatattttgctaaatacagaaggacatgcaaaacttgcagattttggggtagcaggtcaacttacagataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggcaatcttcatgattcctacaaatcctcctcccacattccgaaaaccagagctatggtcagataactttacagattttgtgaaacagtgtcttgtaaagagccctgagcagagggccacagccactcagctcctgcagcacccatttgtcaggagtgccaaaggagtgtcaatactgcgagacttaattaatgaagccatggatgtgaaactgaaacgccaggaatcccagcagcgggaagtggaccaggacgatgaagaaaactcagaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagaagggatgagaccatgcagcctgcgaaaccatcctttcttgaatattttgaacaaaaagaaaaggaaaaccagatcaacagctttggcaagagtgtacctggtccactgaaaaattcttcagattggaaaataccacaggatggagactacgagtttcttaagagttggacagtggaggaccttcagaagaggctcttggccctggaccccatgatggagcaggagattgaagagatccggcagaagtaccagtccaagcggcagcccatcctggatgccatagaggctaagaagagacggcaacaaaacttctgagcaaggccaggctgtgagggccccagctccacccaggctttgggtgaattctggatggcttgcctcatgtttgttagccagcacttctgctctgtcgtctctccacagcacctttgtgaactcaggaatgtgcgccagtgggaagggctctcttgacagtcagcgtgccatcttgatgtgtgtatgtacattggtcaggtatattatctcaaaggatttatattggcgcttttaactcagagttttaaaccccaggaacagagactcctagttgagtgatagctgggaaagttttacattgtctgtttttcttctcccaatagctttcaattgttctttctggaagacttttaaaaaaatataaatatgcatatatatatataaattataaatagattccccacgcagtgtggtggcatctctgtacaggtacagttttaaacggtttgcctcttttctgtaagattatggtactgtggaacatgagggcagaggacaccgggaggctgttagggggtcactgaatcccaggagccaacctccccctttgcagggctgcatttaaaaattaggtttgggacagttcttgtaccgtggtttcagccttgtgtggtcatcactggcttctggagctattggtgatgtccaagggaaagctttgagagtttatgtttactctttgagtcccaggagaagcctggcaccctctttgcaaattggcctttgctctttcaatgcctttcatccatctccactctctcaactgcctaaagtcacagcacagatactgcccagtgccttaagaggagacatgatctctaccagggactctcagcaaacacgggactgtgttcagtccacaaaggaaaagcgtttttgaagctctcattgttcatgtaaaaatcatacacgtggcatgttgctccacattccttacacacaggggtagaggggattgcttttgtgacccacgttcaaatatgtgactgttttcttttctcttttactgctaagcagcctggaaaggataaatgaatattagactaagatttgttttccaggaggctcaatctgaacacacagaatgtcagagctggaagggactatagagatcatctgatctgatcctcttgtacggatgatcgcaaaactgaggtgtagag

SEQ ID NO: 345169 - DNA, 2695 bp, Homo sapiens
ggaaagcggaagtgtgggagggtctgcggggcgggctcaggaggtccgcgggaggatggagcagtgagcgggtctgggcggctgctggcagcgccatggagacggtacagctgaggaacccgccgcgccggcagctgaaaaagttggatgaagatagtttaaccaaacaaccagaagaagtatttgatgtcttagagaaacttggagaagggtcctatggcagcgtatacaaagctattcataaagagaccggccagattgttgctattaagcaagttcctgtggaatcagacctccaggagataatcaaagaaatctctataatgcagcaatgtgacagccctcatgtagtcaaatattatggcagttattttaagaacacagacttatggatcgttatggagtactgtggggctggttctgtatctgatatcattcgattacgaaataaaacgttaacagaagatgaaatagctacaatattacaatcaactcttaagggacttgaataccttcattttatgagaaaaatacaccgagatatcaaggcaggaaatattttgctaaatacagaaggacatgcaaaacttgcagattttggggtagcaggtcaacttacagataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggcaatcttcatgattcctacaaatcctcctcccacattccgaaaaccagagctatggtcagataactttacagattttgtgaaacagtgtcttgtaaagagccctgagcagagggccacagccactcagctcctgcagcacccatttgtcaggagtgccaaaggagtgtcaatactgcgagacttaattaatgaagccatggatgtgaaactgaaacgccaggaatcccagcagcgggaagtggaccaggacgatgaagaaaactcagaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagaagggatgagaccatgcagcctgcgaaaccatcctttcttgaatattttgaacaaaaagaaaaggaaaaccagggtccactgaaaaattcttcagattggaaaataccacaggatggagactacgagtttcttaagagttggacagtggaggaccttcagaagaggctcttggccctggaccccatgatggagcaggagattgaagagatccggcagaagtaccagtccaagcggcagcccatcctggatgccatagaggctaagaagagacggcaacaaaacttctgagcaaggccaggctgtgagggccccagctccacccaggctttgggtgaattctggatggcttgcctcatgtttgttagccagcacttctgctctgtcgtctctccacagcacctttgtgaactcaggaatgtgcgccagtgggaagggctctcttgacagtcagcgtgccatcttgatgtgtgtatgtacattggtcaggtatattatctcaaaggatttatattggcgcttttaactcagagttttaaaccccaggaacagagactcctagttgagtgatagctgggaaagttttacattgtctgtttttcttctcccaatagctttcaattgttctttctggaagacttttaaaaaaatataaatatgcatatatatatataaattataaatagattccccacgcagtgtggtggcatctctgtacaggtacagttttaaacggtttgcctcttttctgtaagattatggtactgtggaacatgagggcagaggacaccgggaggctgttagggggtcactgaatcccaggagccaacctccccctttgcagggctgcatttaaaaattaggtttgggacagttcttgtaccgtggtttcagccttgtgtggtcatcactggcttctggagctattggtgatgtccaagggaaagctttgagagtttatgtttactctttgagtcccaggagaagcctggcaccctctttgcaaattggcctttgctctttcaatgcctttcatccatctccactctctcaactgcctaaagtcacagcacagatactgcccagtgccttaagaggagacatgatctctaccagggactctcagcaaacacgggactgtgttcagtccacaaaggaaaagcgtttttgaagctctcattgttcatgtaaaaatcatacacgtggcatgttgctccacattccttacacacaggggtagaggggattgcttttgtgacccacgttcaaatatgtgactgttttcttttctcttttactgctaagcagcctggaaaggataaatgaatattagactaagatttgttttccaggaggctcaatctgaacacacagaatgtcagagctggaagggactatagagatcatctgatctgatcctcttgtacggatgatcgcaaaactgaggtgtagag

SEQ ID NO: 345170 - DNA, 2765 bp, Homo sapiens
ggaaagcggaagtgtgggagggtctgcggggcgggctcaggaggtccgcgggaggatggagcagtgagcgggtctgggcggctgctggcagcgccatggagacggtacagctgaggaacccgccgcgccggtcttcacatcctcctcagctcttcagaacctgacattgggaggcagctgaaaaagttggatgaagatagtttaaccaaacaaccagaagaagtatttgatgtcttagagaaacttggagaagggtcctatggcagcgtatacaaagctattcataaagagaccggccagattgttgctattaagcaagttcctgtggaatcagacctccaggagataatcaaagaaatctctataatgcagcaatgtgacagccctcatgtagtcaaatattatggcagttattttaagaacacagacttatggatcgttatggagtactgtggggctggttctgtatctgatatcattcgattacgaaataaaacgttaacagaagatgaaatagctacaatattacaatcaactcttaagggacttgaataccttcattttatgagaaaaatacaccgagatatcaaggcaggaaatattttgctaaatacagaaggacatgcaaaacttgcagattttggggtagcaggtcaacttacagataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggcaatcttcatgattcctacaaatcctcctcccacattccgaaaaccagagctatggtcagataactttacagattttgtgaaacagtgtcttgtaaagagccctgagcagagggccacagccactcagctcctgcagcacccatttgtcaggagtgccaaaggagtgtcaatactgcgagacttaattaatgaagccatggatgtgaaactgaaacgccaggaatcccagcagcgggaagtggaccaggacgatgaagaaaactcagaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagaagggatgagaccatgcagcctgcgaaaccatcctttcttgaatattttgaacaaaaagaaaaggaaaaccagatcaacagctttggcaagagtgtacctggtccactgaaaaattcttcagattggaaaataccacaggatggagactacgagtttcttaagagttggacagtggaggaccttcagaagaggctcttggccctggaccccatgatggagcaggagattgaagagatccggcagaagtaccagtccaagcggcagcccatcctggatgccatagaggctaagaagagacggcaacaaaacttctgagcaaggccaggctgtgagggccccagctccacccaggctttgggtgaattctggatggcttgcctcatgtttgttagccagcacttctgctctgtcgtctctccacagcacctttgtgaactcaggaatgtgcgccagtgggaagggctctcttgacagtcagcgtgccatcttgatgtgtgtatgtacattggtcaggtatattatctcaaaggatttatattggcgcttttaactcagagttttaaaccccaggaacagagactcctagttgagtgatagctgggaaagttttacattgtctgtttttcttctcccaatagctttcaattgttctttctggaagacttttaaaaaaatataaatatgcatatatatatataaattataaatagattccccacgcagtgtggtggcatctctgtacaggtacagttttaaacggtttgcctcttttctgtaagattatggtactgtggaacatgagggcagaggacaccgggaggctgttagggggtcactgaatcccaggagccaacctccccctttgcagggctgcatttaaaaattaggtttgggacagttcttgtaccgtggtttcagccttgtgtggtcatcactggcttctggagctattggtgatgtccaagggaaagctttgagagtttatgtttactctttgagtcccaggagaagcctggcaccctctttgcaaattggcctttgctctttcaatgcctttcatccatctccactctctcaactgcctaaagtcacagcacagatactgcccagtgccttaagaggagacatgatctctaccagggactctcagcaaacacgggactgtgttcagtccacaaaggaaaagcgtttttgaagctctcattgttcatgtaaaaatcatacacgtggcatgttgctccacattccttacacacaggggtagaggggattgcttttgtgacccacgttcaaatatgtgactgttttcttttctcttttactgctaagcagcctggaaaggataaatgaatattagactaagatttgttttccaggaggctcaatctgaacacacagaatgtcagagctggaagggactatagagatcatctgatctgatcctcttgtacggatgatcgcaaaactgaggtgtagag

SEQ ID NO: 345171 - DNA, 1717 bp, Homo sapiens
ggaaagcggaagtgtgggagggtctgcggggcgggctcaggaggtccgcgggaggatggagcagtgagcgggtctgggcggctgctggcagcgccatggagacggtacagctgaggaacccgccgcgccggcagctgaaaaagttggatgaagatagtttaaccaaacaaccagaagaagtatttgatgtcttagagaaacttggagaagggtcctatggcagcgtatacaaagctattcataaagagaccggccagattgttgctattaagcaagttcctgtggaatcagacctccaggagataatcaaagaaatctctataatgcagcaatgtgacagccctcatgtagtcaaatattatggcagttattttaagaacacagacttatggatcgttatggagtactgtggggctggttctgtatctgatatcattcgattacgaaataaaacgttaacagaagatgaaatagctacaatattacaatcaactcttaagggacttgaataccttcattttatgagaaaaatacaccgagatatcaaggcaggaaatattttgctaaatacagaaggacatgcaaaacttgcagattttggggtagcaggtcaacttacagataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggcaatcttcatgattcctacaaatcctcctcccacattccgaaaaccagagctatggtcagataactttacagattttgtgaaacagtgtcttgtaaagagccctgagcagagggccacagccactcagctcctgcagcacccatttgtcaggagtgccaaaggagtgtcaatactgcgagacttaattaatgaagccatggatgtgaaactgaaacgccaggaatcccagcagcgggaagtggaccaggacgatgaagaaaactcagaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagtaaggctctgagtaaattcactgacttcttagaccaagcatacatatttcagagaagacagattctcatggttcatgcaggcttagccttgggttctttcttttgtcacaaccaaaggagtagaaaacttggaagtttgcgatggggacaggaggtttggtgagggggaaagctggcctgtggagtcaaagtcaagaaagcatcaacagtgagaaagaattttgcttttgaaccagagcagccattttctcattgaatgttgttattattttccttccttaccttgatctttggaggcaagcacatgcattgtttgatgcataattcctgtgaaggtgtaatgacattctgagttatttactgtacatacatcttcagtttattttcatgacagtttgggtctaacccaagtttaccaatactgtcagtcaatgaaagatgactgtacaagttgaaaagttctatccagtttct

SEQ ID NO: 345172 - DNA, 1963 bp, Homo sapiens
tcggccagatcccctttcatccaatgagggcaatcttcatgattcctacaaatcctcctcccacattccgaaaaccagagctatggtcagataactttacagattttgtgaaacagtgtcttgtaaagagccctgagcagagggccacagccactcagctcctgcagcacccatttgtcaggagtgccaaaggagtgtcaatactgcgagacttaattaatgaagccatggatgtgaaactgaaacgccaggaatcccagcagcgggaagtggaccaggacgatgaagaaaactcagaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagaagggatgagaccatgcagcctgcgaaaccatcctttcttgaatattttgaacaaaaagaaaaggaaaaccagatcaacagctttggcaagagtgtacctggtccactgaaaaattcttcagattggaaaataccacaggatggagactacgagtttcttaagagttggacagtggaggaccttcagaagaggctcttggccctggaccccatgatggagcaggagattgaagagatccggcagaagtaccagtccaagcggcagcccatcctggatgccatagaggctaagaagagacggcaacaaaacttctgagcaaggccaggctgtgagggccccagctccacccaggctttgggtgaattctggatggcttgcctcatgtttgttagccagcacttctgctctgtcgtctctccacagcacctttgtgaactcaggaatgtgcgccagtgggaagggctctcttgacagtcagcgtgccatcttgatgtgtgtatgtacattggtcaggtatattatctcaaaggatttatattggcgcttttaactcagagttttaaaccccaggaacagagactcctagttgagtgatagctgggaaagttttacattgtctgtttttcttctcccaatagctttcaattgttctttctggaagacttttaaaaaaatataaatatgcatatatatatataaattataaatagattccccacgcagtgtggtggcatctctgtacaggtacagttttaaacggtttgcctcttttctgtaagattatggtactgtggaacatgagggcagaggacaccgggaggctgttagggggtcactgaatcccaggagccaacctccccctttgcagggctgcatttaaaaattaggtttgggacagttcttgtaccgtggtttcagccttgtgtggtcatcactggcttctggagctattggtgatgtccaagggaaagctttgagagtttatgtttactctttgagtcccaggagaagcctggcaccctctttgcaaattggcctttgctctttcaatgcctttcatccatctccactctctcaactgcctaaagtcacagcacagatactgcccagtgccttaagaggagacatgatctctaccagggactctcagcaaacacgggactgtgttcagtccacaaaggaaaagcgtttttgaagctctcattgttcatgtaaaaatcatacacgtggcatgttgctccacattccttacacacaggggtagaggggattgcttttgtgacccacgttcaaatatgtgactgttttcttttctcttttactgctaagcagcctggaaaggataaatgaatattagactaagatttgttttccaggaggctcaatctgaacacacagaatgtcagagctggaagggactatagagatcatctgatctgatcctcttgtacggatgatcgcaaaactgaggtgtagag

SEQ ID NO: 345173 - DNA, 1009 bp, Homo sapiens
ggaaagcggaagtgtgggagggtctgcggggcgggctcaggaggtccgcgggaggatggagcagtgagcgggtctgggcggctgctggcagcgccatggagacggtacagctgaggaacccgccgcgccggcagctgaaaaagttggatgaagatagtttaaccaaacaaccagaagaagtatttgatgtcttagagaaacttggagaagggtgagtgtaaagaaactataggtaggtcattgggtcccagtctttttcctgccccagaagaagcagaaggatatgaacctttcagcattgttctaggtggggtggaaggtaaatttacagcttgtgatgtccttcttcgctttactccaatccctattatagacagatttagtgattcctggtctttttaacacgaagaatatctattgttttctcttttgtaggatctgtatgattttatctacttaacagatagcactaattagattaaaattctataagaaactttttaatttgctgttcataatttctgattggtatgcaataactgtttcaatgaaaatcaatgtaatttagtattttaatatttgcacctttgtgaaatatagtaaataaattaagcactatcaccaccttcacagctacttaggagatccacaatcctgggttgggagccagtggatttcctgaaacacagatttgttaatgcgtttataaaatactgatgaaatgatattagtaatgtgcagtgaccatcattgactttcatgatacaattaagtttacataatttttatacttttatatatcattttaattcaatcctgtgtatttattccttcttctgtaatgaccaggaaattaaaatgttaatgacaccatttcttaagtttttcttgttaatttttgaataggcgatacaatcatatgattcaaaatttaaaaaaatattaagacgcatacaataaaaaaaaaaaaactgcctcctacctctctctgtctcttagccacccagaa

SEQ ID NO: 345174 - DNA, 1879 bp, Homo sapiens
ggaaagcggaagtgtgggagggtctgcggggcgggctcaggaggtccgcgggaggatggagcagtgagcgggtctgggcggctgctggcagcgccatggagacggtacagctgaggaacccgccgcgccggcagctgaaaaagttggatgaagatagtttaaccaaacaaccagaagaagtatttgatgtcttagagaaacttggagaagggtcctatggcagcgtatacaaagctattcataaagagaccggccagattgttgctattaagcaagttcctgtggaatcagacctccaggagataatcaaagaaatctctataatgcagcaatgtgacagccctcatgtagtcaaatattatggcagttattttaagaacacagacttatggatcgttatggagtactgtggggctggttctgtatctgatatcattcgattacgaaataaaacgttaacagaagatgaaatagctacaatattacaatcaactcttaagggacttgaataccttcattttatgagaaaaatacaccgagatatcaaggcaggaaatattttgctaaatacagaaggacatgcaaaacttgcagattttggggtagcaggtcaacttacagataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggcaatcttcatgattcctacaaatcctcctcccacattccgaaaaccagagctatggtcagataactttacagattttgtgaaacagtgtcttgtaaagagccctgagcagagggccacagccactcagctcctgcagcacccatttgtcaggagtgccaaaggagtgtcaatactgcgagacttaattaatgaagccatggatgtgaaactgaaacgccaggaatcccagcagcgggaagtggaccaggacgatgaagaaaactcagaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagaagggatgagaccatgcagcctgcgaaaccatcctttcttgaatattttgaacaaaaagaaaaggaaaaccagatcaacagctttggcaagagtgtacctggtccactgaaaaattcttcagattggaaaataccacaggatggagactacgagtttcttaagagttggacagtggaggaccttcagaagaggctcttggccctggaccccatgatggagcaggagattgaagagatccggcagaagtaccagtccaagcggcagcccatcctggatgccatagaggctaagaagagacggcaacaaaacttctgagcaaggccaggctgtgagggccccagctccacccaggctttgggtgaattctggatggcttgcctcatgtttgttagccagcacttctgctctgtcgtctctccacagcacctttgtgaactcaggaatgtgcgccagtgggaagggctctcttgacagtcagcgtgccatcttgatgtgtgtatgtacattggtcaggtatattatctcaaaggatttatatttttttaaaagtcttccagaaagaacaattgaaagctattgggagaagaaaaacagacaatgtaaaactttcccagctatcactcaactaggagtct

SEQ ID NO: 345175 - DNA, 1343 bp, Homo sapiens
ggaaagcggaagtgtgggagggtctgcggggcgggctcaggaggtccgcgggaggatggagcagtgagcgggtctgggcggctgctggcagcgccatggagacggtacagctgaggaacccgccgcgccggcagctgaaaaagttggatgaagatagtttaaccaaacaaccagaagaagtatttgatgtcttagagaaacttggagaagggtcctatggcagcgtatacaaagctattcataaagagaccggccagattgttgctattaagcaagttcctgtggaatcagacctccaggagataatcaaagaaatctctataatgcagcaatgtgacagccctcatgtagtcaaatattatggcagttattttaagaacacagacttatggatcgttatggagtactgtggggctggttctgtatctgatatcattcgattacgaaataaaacgttaacagaagatgaaatagctacaatattacaatcaactcttaagggacttgaataccttcattttatgagaaaaatacaccgagatatcaaggcaggaaatattttgctaaatacagaaggacatgcaaaacttgcagattttggggtagcaggtcaacttacagataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggcaatcttcatgattcctacaaatcctcctcccacattccgaaaaccagagctatggtcagataactttacagattttgtgaaacagtgtcttgtaaagagccctgagcagagggccacagccactcagctcctgcagcacccatttgtcaggagtgccaaaggagtgtcaatactgcgagacttaattaatgaagccatggatgtgaaactgaaacgccaggaatcccagcagcgggaagtggaccaggacgatgaagaaaactcagaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagaagggaggagaccagagcagcctccgaaaccatacattagggaataccaggaacaagaaagacaaagagcaaaccagagcaacaccagaggcaagagtcg

SEQ ID NO: 345176 - DNA, 1092 bp, Homo sapiens
ggaaagcggaagtgtgggagggtctgcggggcgggctcaggaggtccgcgggaggatggagcagtgagcgggtctgggcggctgctggcagcgccatggagacggtacagctgaggaacccgccgcgccggcagctgaaaaagttggatgaagatagtttaaccaaacaaccagaagaagtatttgatgtcttagagaaacttggagaagggtcctatggcagcgtatacaaagctattcataaagagaccggccagattgttgctattaagcaagttcctgtggaatcagacctccaggagataatcaaagaaatctctataatgcagcaatgtgacagccctcatgtagtcaaatattatggcagttattttaagaacacagacttatggatcgttatggagtactgtggggctggttctgtatctgatatcattcgattacgaaataaaacgttaacagaagatgaaatagctacaatattacaatcaactcttaagggacttgaataccttcattttatgagaaaaatacaccgagatatcaaggcaggaaatattttgctaaatacagaaggacatgcaaaacttgcagattttggggtagcaggtcaacttacagtaagtaaaaatattacttgtattgataattttcatttctgtcctgagaagcagttccttttatttacctatttttaaaatataatacttgacttaattgtattagtaaaaaatcacagaatctgccaataggttacaaaagagctagttagtgggttattttagatcttttcctggggttcaggtcacatagcttaactttgttcaacttttataaagatgaaaagtaaagcaagaaatgatagattactctagtgcactacatcaacatatttataaaaggaagaaaaattaagaggaagaaaaattaagtccaaactgctttccttgactaagacataacatcatctcattcaacttccaggtagtacttggcagttactgtactgaaaacactctgttcgtttgagtccaggatacagtctcttgattcttctcctgcctaactagtgcatggaagtgaaaaaaaaaa

SEQ ID NO: 345177 - DNA, 359 bp, Homo sapiens
ggttccacttcattatctccataatcaaacctggggctgcataagaagagcacaaccactctccaagtgatttaacaggatgctttaatgatgtattgagaatgaacattgatcccagatgagcaaagcaaggcttaaagagctaaggagactgtgggaatgaaggtttcgaagtggtctgaatggagaaagaagcggtgggagagctgagtcatcatgcagcacacggcaaggtagcagaaaaccctggagaacaacagcagcctgccccagagtcagccgtgagcgctgatttagtttcaggaaaacaataacactttgtcccattaaattaatgttgttaatttgaagtttattgg

SEQ ID NO: 345178 - DNA, 434 bp, Homo sapiens
tgatttaacaggatgctttaatgatgtattgagaatgaacattgatcccaggtaagaggtgctaaactgatactttaaaagcacaccacccatttcgctctgatggactctcctccttaaatcaccgtgttgtcatttttacgatgcagatctagctattgaggctacaggactgtgaaatgtcatataaaaaagccaataagaaaaaaataaaattaagttgcggagagcgtgtattagcatttcaaaaatgttctgttgcattatgctattattctctctctgtcaaggggcactgggatcctttcctccccataaagagactgtgccacagaatgtattagcgctccgttcctgaaacggcgtggcagctgaagggcatagttacaataatggcaaaatacattccggactaaatttgataggacgtgggg

SEQ ID NO: 345179 - DNA, 412 bp, Homo sapiens
aagaatgtgtctcttcaatgcacgttgtaactttctctttgaatttattgaagaaccacaaattaagtctgtgtctttattgaagcaattcaggtgatgggaagaggctcttgaatcaagaaagaaaggaagaaccaggagtggtgatattaggtaaggggagatttaggatcactcttccgcaatacaaaatgaacttcctgtgctaagaaaacttacagccctgaataaggagttgatggcatgtctatgcaacgtacaattttattcctgggacgtcgttggaaaaccattatattagatgatcttcaatcttttgtagttctgaaaatttatgaacgcttatacatgttgcttataaatcctaaatgaaaaaagggctccctgtcttaaatttatgttctatctaata

SEQ ID NO: 345180 - DNA, 818 bp, Homo sapiens
gccagcttcaaattctccagagagtctgattaggccacttgtggttgagtaaaccatgactggaggggtagtcttctgggcggcacaaggaagtagttttccagggcctctgctgctcaatctggagcctttgtacaaattaggaaaaagtgcccctcagggccaaagtataaaaaggcacccctctgggtagacaacctgctttactggtaggcttggcacttttagagggtgtgtagcggttgcttcttccctggactttagctcttatctgccctctggcaagtaataccatgttgtgtattttcttttctgtcttactgcattagctacatctttcaaaaacatgttgaaaagcagtgataagagggtcatccttgccttattattgatcttagcaggaaaacttcaagttttttgccattaaatatgagttaggcttggtggcttatgcctttaatctccgcacttagaggggctgaggtgagcagatcacttcagaccagactggccaacatggtgaaaatccgtccctactgaaaatagaaacattagccaggtacagtggcgcatgcctatagtcccagctactcaggaggctgaggtgggagaatcacttgagcctgggaggcagaggttgcagtgagctaagatcgtgccactacactacagccagggcaacagataccctgtcttagggaaaacaaaaacaacaatgaataaactctcaaaacctttttaaaaagcataaattagtgtagattttttatagatgttatcaatgagaaagatccctctattctagttgctgagagttt

SEQ ID NO: 345181 - DNA, 367 bp, Homo sapiens
gctgtctcccaaaaacacatctgatctttatgaaatctcagcttcagagctccccaggatgttactgttactgaaggggagtgaaaaggaggaagaagagagagaaggagggctccaaacccatcccaagttgattccttcatgatgtttccaagaatttaaagaataagtggtgaggctgggcgcagtgactcacgcctgtaatcccagcactttgggaggccaaagcaggcagatcacttgaggtcaggagttcgagaccagcctggtcaacgtggtgaaaccccatccttactaaaaatacaaaaattagccgggtgtggtggtgcatgccggtggtctcagctacttgggaggctgaggcagg

SEQ ID NO: 345182 - DNA, 761 bp, Homo sapiens
cagaaatgtcaattcaggaagagcagctgtgagtcccagcaggacttggctggcgggccaagagcccacttacagggtgctccagagcatcccttggtgcctaccactgcctaggcactaagcgggggcaggtgggagacagaagaatcaaaaacccagcccctctcctggaataatgttttccctgggggacacatcatataactgatgcaaggtggcccaagttcaattctgcaatcaagtgtgacctgaagagtaaaactgtgtgtatgtgtgggaggggagtgcagctagagagcaatccaggaggacttcctgtaggagacaagttttaagtcaggaactaagtgaggtgaaaagaatggattggttgaggaacaatttaggtcagacaggggggtgtccacaggtgcagaggtggggaattggcggtcagtaggggagcagatccaggaggggaaggaatgaggtagaaaggtagtgggtgacttgtggaggtgaggggtgtgcacaggtgtgggtatgtgtatgcatcacaggggagagagccatgagagctgaaagcttccagcagcttttgtgctgtcaagttgttcagtaagagggactggctggttgacagtggagaagtatgagacccagagatggggagaggcctgcccaaactctcccagctgctcatcagccaggccaggcctggaacccagatctctcaggctgatctgggagtaaggtcagagggaggaggctatcaacacatc

SEQ ID NO: 345183 - DNA, 881 bp, Homo sapiens
  misc_feature (1)..(1): n is a, c, g, or t
  misc_feature (5)..(5): n is a, c, g, or t
nctangcgtgaacgactctcttaatttccaccgctacaggtgtatggtggctgatgaaatgggtctaggaaagacaatccaggcaattggaattacttacttctataaagaggaatggcctctgttaatagtggtcccttcgtctctgaggtacccttggacagaagaaattgaaaaatggatcccagagctaagtccagaagaaatcaatgttattcagaataaaactgatgttaggagaatgttgaccagtaaagtgacagttctgggttatggtctcttaaccgcagatgcaaagactttgatagatgcactgaataatcagaacttcaaagtagttatagtggatgaatcacactacatgaaatccagaaatgcaactcgcagcaggattttattgccaatagtacagaaagccagacgagccattcttcttacaggaacaccagctttaggaaggcctgaagagctttttatgcagattgaagctctctttccacaaaaatttggaagatggaccgactatgcaaaaagatactgtaatgcacacatcagagtctcactcccatcgcccaggctggactgcagtggcaccatcatggctcactacaatctctgcctcctgggttcaatcgattcttctgccttagcctcctgagtagctgggattacaggcatgcgccaccatgcccggctaatttttttgtatttttaatagagatggggtttcaccatgttggtcaggctggtcttgaactcctgacctcaggttattaatcattctttattccagtgttttacaaatttgtggtagctatgaaataattggtggactattatacatataggtggatgacctatatgtaaaataaataaaagta

SEQ ID NO: 345184 - DNA, 1076 bp, Homo sapiens
cgctggggtttcgagtagccctggggcttcgagtagcggagtttcgtgagtttttactgactcgaggatcatcatgcctagggttcataacataaaaaagtctcttacacctcacatttcttgtgtgacaaatgaatctgataatctgctggattttttgcctgacagactaagagcaaagctacttccattccagaaagatggcatcatttttgccctcaaaagaaatggcaggtgtatggtggcttatgaaatgggtctaggaaagacaatccaggcaattggaattacttacttctataaagaggaatggcctctgttaatagtggtcccttcgtctctgaggtacccttggacagaagaaattgaaaaatggatcccagagctaagtccagaagaaatcaatgttattcagaataaaactgatgttaggagaatgttgaccagtaaagtgacagttctgggttatggtctcttaaccgcagatgcaaagactttgatagatgcactgaataatcagaacttcaaagtagttatagtggatgaatcacactacatgaaatccagaaatgcaactcgcagcaggattttattgccaatagtacagaaagccagacgagccattcttcttacaggaacaccagctttaggaaggcctgaagagctttttatgcagattgaagctctctttccacaaaaatttggaagatggaccgactatgcaaaaagatactgtaatgcacacatcagagtctcactcccatcgcccaggctggactgcagtggcaccatcatggctcactacaatctctgcctcctgggttcaatcgattcttctgccttagcctcctgagtagctgggattacaggcatgcgccaccatgcccggctaatttttttgtatttttaatagagatggggtttcaccatgttggtcaggctggtcttgaactcctgacctcaggttattaatcattctttattccagtgttttacaaatttgtggtagctatgaaataattggtggactattatacatataggtggatgacctatatgtaaaataaataaaagta

SEQ ID NO: 345185 - DNA, 1127 bp, Homo sapiens
aagccaaccaatggtaaaactaggaggacagccattttgcccacttgtaaaagagctaccttttcccacgagttggagcctgaggtgcggagtttcgtgagtttttactgactcgaggatcatcatgcctagggttcataacataaaaaagtctcttacacctcacatttcttgtgtgacaaatgaatctgataatctgctggattttttgcctgacagactaagagcaaagctacttccattccagaaagatggcatcatttttgccctcaaaagaaatggcaggtgtatggtggcttatgaaatgggtctaggaaagacaatccaggcaattggaattacttacttctataaagaggaatggcctctgttaatagtggtcccttcgtctctgaggtacccttggacagaagaaattgaaaaatggatcccagagctaagtccagaagaaatcaatgttattcagaataaaactgatgttaggagaatgttgaccagtaaagtgacagttctgggttatggtctcttaaccgcagatgcaaagactttgatagatgcactgaataatcagaacttcaaagtagttatagtggatgaatcacactacatgaaatccagaaatgcaactcgcagcaggattttattgccaatagtacagaaagccagacgagccattcttcttacaggaacaccagctttaggaaggcctgaagagctttttatgcagattgaagctctctttccacaaaaatttggaagatggaccgactatgcaaaaagatactgtaatgcacacatcagagtctcactcccatcgcccaggctggactgcagtggcaccatcatggctcactacaatctctgcctcctgggttcaatcgattcttctgccttagcctcctgagtagctgggattacaggcatgcgccaccatgcccggctaatttttttgtatttttaatagagatggggtttcaccatgttggtcaggctggtcttgaactcctgacctcaggttattaatcattctttattccagtgttttacaaatttgtggtagctatgaaataattggtggactattatacatataggtggatgacctatatgtaaaataaataaaagta

SEQ ID NO: 345186 - DNA, 924 bp, Homo sapiens
cgctggggtttcgagtagccctggggcttcgagtagcggagtttcgtgagtttttactgactcgagatgggtctaggaaagacaatccaggcaattggaattacttacttctataaagaggaatggcctctgttaatagtggtcccttcgtctctgaggtacccttggacagaagaaattgaaaaatggatcccagagctaagtccagaagaaatcaatgttattcagaataaaactgatgttagagacatgtcgaccagctaacagctgacagattctgcggcttactggctctacttagaccgcagcatgcacacagcactctctgactcagcactgcaactgcaactaactcagcaacccttcacacagctacgcttactacgctggatgaatcacactacatgaaatccagaaatgcaactcgcagcaggattttattgccaatagtacagaaagccagacgagccattcttcttacaggaacaccagctttaggaaggcctgaagagctttttatgcagattgaagctctctttccacaaaaatttggaagatggaccgactatgcaaaaagatactgtaatgcacacatcagagtctcactcccatcgcccaggctggactgcagtggcaccatcatggctcactacaatctctgcctcctgggttcaatcgattcttctgccttagcctcctgagtagctgggattacaggcatgcgccaccatgcccggctaatttttttgtatttttaatagagatggggtttcaccatgttggtcaggctggtcttgaactcctgacctcaggttattaatcattctttattccagtgttttacaaatttgtggtagctatgaaataattggtggactattatacatataggtggatgacctatatgtaaaataaataaaagta

SEQ ID NO: 345187 - DNA, 2116 bp, Homo sapiens
aaggtatttaatctaaaattttaccaactttgatttgtctggttaggatattttgttttagtggatatgctttaattcggatcaattactgcagtaaatctcatccctaagcatgaaatgttgtcaacaaatacccagttccatttagttatcaattagcccaaataagagatacaaagtataacagtgaccaaccttgtactgttgagttaatttgaacttctaatgacattgaggctaatgtctttagctcaaggttgatcttgttggccatatagatgtgaactagggaaggggaatcaacttacagcatatcacaattgatccttattaagtataaactcttgtaggtcttttcccagaaagaagcttgactagcaggaattctaaaactgaaatatatcaaacagcataaataggaatagacataaagtgctcttctattaaagcctttggtgatctatttactatgatttatattgtacagttcctcgatttacagaaaatcatcaaaattattaatctacatatcttatgtatataaatattgcctaatccatagaaaaaaggatataaagtattaaatatgtgatatatagctatatctatctatctatgtatctaatagggaagttcaagtcacttcaattgaagaaacatatctctgagcataggagcagcctcaggtcctatggtgggatgcagtggacaggagagggggaaattagaaaagagaactatataattgaaaaagggatataaagcattaaatatatgatatatagctatatctatgtatgtatctaacagagaagttcaagtcacttcaattaaagaaacatttttgagcatgggaccagcctcaggtcttatgctgggatgcagtagacaggagatggggaaattagaaaagagaactgtgtaattgaaatgacgtgggctgcacccttaaggaacttataattaatgatgatctgaataaacataccaggataaagatgtcaaatgagtgtgactcccttaaagtagattaaagtgtgcattctttgtttcctaaaatatgattttactgcttgaaattacatttgagttgaagtttagaaactaacatagcattaatatgaataatcatggaaaattattatcctttgaaaactgattgataaatatattccccctcctttagaaacagtcaaaagccacttcaaacaagtttcaaaataaaggaaggtagcaagttaggcgatggattatattttcttgcttgttgtataccagttgtcaaggacattataaggactcccaaaagcattttgaaggatggcaatatcaaataagtgtatgtcctctcaaatgaggcatttttaattgttaaaatctatttggacgctcaggttatgatatgtttatgaaaaataagcttcattatttttatagctacatcctattattcccttttagaaacaagaataacaataagttttaatagttgccatacttagcatttatcaggtctaatgaaaccaatattgaatctctgataaatattttctgatgttactagctatgggaaattagaactggcacaaccctgacattactaagtggaaatgttaggatttttcggcatcgcatgttagaatctctaaaatttaaacattcctgttaaatgactaaggtttgcttttatcaatatgaattctgaaggccaatatcataccattaactatgaaagcttttaattcctaaaaatagttttagagatattcaagcaatgctctcctaatatccatacgcaagtgtgtttatgacacaaattcactagtctgtttaaaaatgaattctttatattgactggtgttccacatatttcagtaatttctgttatgagaggacttgaaatagcaaattgccacacagttaactggatagaccacgtacgtggtgatcataaccacttggtactacacccagaaactcaaaattgtctttctcctgatgagatatgggtgtccttttgtacgtctaggcctaggtaaccagtggagtgattatattagcaaatgtgtttgtatccagagtcttcctgtcattgtaataaaaaatttatttaaaa

SEQ ID NO: 345188 - DNA, 365 bp, Homo sapiens
tgacaggatttaacagcatggaattggaacatgaatttgggagtaatcaacatattgtagtccaattcctgggaatctagtgtgagaacagaagaggacccaggggtgtaaacttgaaaataccaatatccaaggggaaggaggaagagagaaagtgagggaatgaagcagagaaaaagtgatatgagatgaaaaagaatcagaaaagcagagccatggaaactctgggagggaagacttccacagagtactagtaagataaacatatatttgtgctaaaggatatggcaatcagataggtcatcagtgaaactaagggaagcaatttcagcattgaagctgtgttgactattgctcaaatccca

SEQ ID NO: 345189 - DNA, 1319 bp, Homo sapiens
tctaagagaggatgaactgtaaaacgcacccaagctgactaaatgaggacttgcctcctaaaatcattctcacaaatctctcctgtaactggcctaaacaaactctcctggtaggccaagacaaccagcgagttcctcagggccaacctagctcctgaagaagaacttaggatatgaaggaggggtgcaagaaagtaagatgaaacaaacagtaagaataaaataaccttactaaaagcttacatttattgagcacttttaatgtgatgggctctttgctaagcattttatgggcactatattatttaatcttcatgacccaatgaagatgaccattatctacatttttaaaatgagaaaattacaagtccaatcataagtgcttcttcactggcctaaactgggaacaaaaattttcaggactaaagtaaaagctgaactcatacctagctcttgccaggcacagaggtaacagttaagcatacacaagtgacaaaatgactcatcagaattaaatccaaagtataaaatcaagactatctctacaatcctgccttagccggatgcttctgaaacattctctccttcaagatcagtgatcacattttccccaaactacagggactcagtaatgagaactgaaatacttttcagtatgatatccagtccagaacatgttgaaataccaaacaagaagacccataaccaaacatattaacaataaaatgctaaattatgtagcatgaatggctaccacatatctatgtcctccatcatttatttcaaaaagaaaagccttgtccctcacttcataatcagggctcaaatatattcagtatataggagctttttttaaaaaatgtctctccccctagacttgctttatcaattaaagattccattgattacagaaaagggtcataagacaaatgtgagtaatgtgttccagcattgtgctgaattactgatcacaaaataaaaatacaatccagcctggacattggatgactaagttttgttactcaggctttatactgataaccctaaagttccaaaacaagttgtgaatggcagctttgcaaaggtatacatgtgaactcaacgcttagtcaagctgaagtgcaggagggagttactcagctgtgacacacccagtgtaaccaagccacaaagttactttcacctgtacacaaaatactcttagaggaatttttttttaagtttctttgttcaagtgacaccatatcaagaaagccaagttcttcaaggaagcaaagttctaaggttaccaagaagcagctaaaaactaaaggatctta

SEQ ID NO: 345190 - DNA, 1375 bp, Homo sapiens
tctaagagaggatgaactgtaaaacgcacccaagctgactaaatgaggacttgcctcctaaaatcattctcacaaatctctcctgtaactggcctaaacaaactctcctggtaggccaagacaaccagcgagttcctcagggccaacctagctcctgaagaagaacttaggatatgaaggaggggtgcaagaaagtaagatgaaacaaacagtaagaataaaataaccttactaaaagcttacatttattgagcacttttaatgtgatgggctctttgctaagcattttatgggcactatattatttaatcttcatgacccaatgaagatgaccattatctacatttttaaaatgagaaaattacaagtccaatcataagtgcttcttcactggcctaaactgggaacaaaaattttcaggactaaagtaaaagctgaactcatacctagctcttgccaggcacagaggtaacagttaagcatacacaagtgacaaaatgactcatcagaattaaatccaaagtataaaatcaagactatctctacaatcctgccttagccggatgcttctgaaacattctctccttcaagatcagtgatcacattttccccaaactacagggactcagtaatgagaactgaaatacttttcagtatgatatccagtccagaacatgttgaaataccaaacaagaagacccataaccaaacatattaacaataaaatgctaaattatgtagcatgaatggctaccacatatctatgtcctccatcatttatttcaaaaagaaaagccttgtccctcacttcataatcagggctcaaatatattcagtatataggagctttttttaaaaaatgtctctccccctagacttgctttatcaattaaagattccattgattacagaaaagggtcataagacaaatgtgagtaatgtgttccagcattgtgctgaattactgatcacaaaataaaaatacaatccagcctggacattggatgactaagttttgttactcaggctttatactgataaccctaaagttccaaaacaagttgtgaatggcagctttgcaaaggtatacatgtgaactcaacgcttagtcaagctgaagtgcaggagggagttactcagctgtgacacacccagtgtaaccaagccacaaagttactttcacctgtacacaaaatactcttagaggaatttttttttaagtttctttgcacgcagattttgcactcagatttgtgcccacgtttctaattggagtggaaagaaatgcagtcaccaaatccacacccgcatgctctgtgtccaagggtttagtaatctgctctaccagtatatccagacacacaattgctgggga

SEQ ID NO: 345191 - DNA, 562 bp, Homo sapiens
attcttattagtgtcttatagtgaatgtatgtacattttttgttgtatagacctaaaagtagaattcctaagttagaagctttagcagctactaccaaacaattttccaaatggttatacaaatttacacctccaccaacggtcctgagaattcccattgctccacattcttgccactatttaataatgttaggttttaaattttaacaattcttggggtgtgtagtggtactctttgtaggaaaatgcaaattagtgatgttgagtacttttcactcatcagccgtttgggtatctggtaattcatgagataaagtacccactgcaatctggtgtccatttaaaaaaatgatgtatagttcttatttctggatatacagacctttataggatatatattgtttcaaatagctttcacactctgtgacttgcctttgggactctctcggtgatttttttaaatgaacggaagttctgagttttaatgaattcctatttatcagtatttttctttgtagttggtactgttcattttctgttaggaatttttgcctatctcaga

SEQ ID NO: 345192 - DNA, 425 bp, Homo sapiens
cactgcatgttctcactcataggtgggaattgaacaatgagaacacttggacacagggtggggaacatcacacatgggggcctgtcgtgtggtggggggaggggagagggatagcattagaagatatacctaatgtaaatgacgagttaatgggtgcagcacaccaacatggcacatgtatacatatgtaacaaacctgcacattgtgcacatgtaccctagaacttaaagtataataaaataaataaattttaaaaaaaagaatagacttttcaacaaatggtattgagacgtgcgtagccacattagaaaagaataaaatgaactccttcctaatgatatatccaaaaagtaattcaaagtgattcaaaaatcccaatgtaaggggtaaaaagctataaaatcttagaggaatacatctttgg

SEQ ID NO: 345193 - DNA, 1117 bp, Homo sapiens
ctttcatggtgaaagtttttagttcaggtttaaatgaaacttttctcttttcctctctagcccggatatgggtaaataaacgactagctgagcctatcgggcccagcatggcttgagaggcagcgggcgagctcgagcaactattatccacttcgctcgcattactcccgcgcactcgcaaaacgcggactggactcgtccccgggccgccgccgcccgccccggcgcagcctcgcgggacccagccgggctggggctaaggctggggccggggccggggccggggcggctcggcggccgctcggagcgcggcggcgtggggcggccggaacctgcactttccccccgggccgctgtctccttgccaaccgggcgttcgcatgtttgttttcacgtctaaaaggaacgatacaaaggtggaaaacgagtctgacgagcagacaaaagagggagaagggctgggaaacaaagttgtctattggcctcagaggttacaaggagccgacggagaaagaaaatatttaggcaatctgcaaaagcacggtctctcccaggagttatgtaattttcagaacgttcgcctctgccttgatttcgggccatcggcgtaattcccacaacttcttccaactgcaaaattaggaaagatttgaaatgaaggttagccccggtcagagagccctatggcctgtacccagtaggtactcaataaatgcttatgactgactgcacccgccccaaagagaatgtttacataactctttttgaaggcaccttaaacacgtatgtaggtttgtcagtgtatttccaaaggaatatgtccacgtattcccaaaggagcatttttcttacatgcacttggatgtcctctgtggagtatgtacagtggtgttttctgcgccaactttcacatgaacatttaactcttggtgccagaacagcgacagctatgggttagctcgtatcttcataaatctatatgacacctttcatcatgtttcagagcttcgtgtgcacagttaaccctctcgatatacattcatttcaaagagatgtggaacgaaactaaaatattatagacattatatttaataaatataacttcaataataaataa

SEQ ID NO: 345194 - DNA, 1068 bp, Homo sapiens
ctttcatggtgaaagtttttagttcaggtttaaatgaaacttttctcttttcctctctagcccggatatgggtaaataaacgactagctgagcctatcgggcccagcatggcttgagaggcagcgggcgagctcgagcaactattatccacttcgctcgcattactcccgcgcactcgcaaaacgcggactggactcgtccccgggccgccgccgcccgccccggcgcagcctcgcgggacccagccgggctggggctaaggctggggccggggccggggccggggcggctcggcggccgctcggagcgcggcggcgtggggcggccggaacctgcactttccccccgggccgctgtctccttgccaaccgggcgttcgcatgtttgttttcacgtctaaaaggaacgatacaaaggtggaaaacgagtctgacgagcagacaaaagagggagaagggctgggaaacaaagttgtctattggcctcagagcacggtctctcccaggagttatgtaattttcagaacgttcgcctctgccttgatttcgggccatcggcgtaattcccacaacttcttccaactgcaaaattaggaaagatttgaaatgaaggttagccccggtcagagagccctatggcctgtacccagtaggtactcaataaatgcttatgactgactgcacccgccccaaagagaatgtttacataactctttttgaaggcaccttaaacacgtatgtaggtttgtcagtgtatttccaaaggaatatgtccacgtattcccaaaggagcatttttcttacatgcacttggatgtcctctgtggagtatgtacagtggtgttttctgcgccaactttcacatgaacatttaactcttggtgccagaacagcgacagctatgggttagctcgtatcttcataaatctatatgacacctttcatcatgtttcagagcttcgtgtgcacagttaaccctctcgatatacattcatttcaaagagatgtggaacgaaactaaaatattatagacattatatttaataaatataacttcaataataaataa

SEQ ID NO: 345195 - DNA, 88 bp, Homo sapiens
gtatggtggcatccaggagttcacatgatgtcatcaggaatctgcctccctccatcacttagctctcttctcctctgtgctggcctca

SEQ ID NO: 345196 - DNA, 176 bp, Homo sapiens
tgaatgaatctaagtgaattttttgggcatctcatgccttaaagggggctggggctgcggcaaggaagtaggcgtcgttggtcactgcaagaggccccaggctccttggcccctttatctcctacatttgaatcccccccccaccccttttttgttgttgttgttttgatatggag

SEQ ID NO: 345197 - DNA, 309 bp, Homo sapiens
atcaaataagcctagttagtttcacatatcaaataagcctagttagtttcacatttatttgctcaatgcttcccatgcaaagatgcttaattagtttaatgtctgtgtttttttttttttttttaaagaaatagaacaagattttctaggggccgttgaaaaatcccagagttagtctaaggtcagaaaagacttcattcagaatttgatttttgagacgtttataaaaagaatacccaaaagattcaagattcaaagcacttgattaaataggattacaggtatttagttatccatttaaccaaagtg

SEQ ID NO: 345198 - DNA, 240 bp, Homo sapiens
gggcgatgtggcctgaggtcagctgcctactttgaaatgcatcgggaacaacggatagatgtttagatgggtggacagatggatgatgaatggatggatgatgggtagatggacagatttttggatcagtggatggatgatggctgggtggacagatgtttagatgggtggacagatggatgatggatggatgggtgaatgggtaggtggatggatgatgggcaggtggacagatgtttg

SEQ ID NO: 345199 - DNA, 547 bp, Homo sapiens
cctcacgtggtcgtccctctgtgtgtgtctgtgtcctcatctcctcttcttaggactccagtcctgttggaatagggcccattctagtgaccacattttaccgtaatcacctgtttacatgacctgtctccaaatacagtggatattggaaggacacagttcagcccatagcatactgttggctggtttattatgagaccatgatatttactattcattcatcccaagacaatgagaccttttacccatgtcccaggatacacatatcttaacatctgctgttgtctgaatacgtcctttccaaattcatatattgagacagtaacccccaaagctatggaattaaaaggtggagctttgggggaagtgattagatcgtgagggtgaagccgctgaacaggaccagtgccctcggtgaaggggcctgagggagcccgtttccccttggtccatgggaggacagcgagaagggcccttccctcaggaatgggcccttaccacgcagttcatcagcaggcgccccgaccacgacttccagcctccagaa

SEQ ID NO: 345200 - DNA, 219 bp, Homo sapiens
tattctttcaccagagaatttgttttccaggatcaatgagaatttcatatacacttgttgatttctctttttaaacatattacttttctttagtgagtccctttttttgtgggtcgcatttattaaaacagttgctaatttcagaacatttcttgctttcattgttttgccttcaaatattataatgcttgagggtaaggcaatacacacacacacaca

SEQ ID NO: 345201 - DNA, 390 bp, Homo sapiens
ctgctgctgatcagagctcaggagcagaagggggtggagggagagagtgttggaggccataagcatggggtggaggtctcaggacaaggcctcacctggggaacaggagaagccccaattttcagaagagaggggagttgattgagaagtgtaagattgttacttgagaataatcttgagggtatgaaggtagggtaagggagaatggtgataaactctctggggaatcagaaattgagatggagtagctgggtggggtggcatgtgcctgtagctactcaggaggctgaggtgggaggactgcttgagcccaggagttcaaggccgcagtgagctatgatcacaccactgcactccagcctgggtgacacagcgagaccttgtctctgg

SEQ ID NO: 345202 - DNA, 189 bp, Homo sapiens
ctgctgctgatcagagctcaggagcagaagggggtggagggagagagtgttggaggccataagcatggggtggaggtctcaggacaaggcctcacctggggaacaggagaagccccaattttcagaagagaggggagggggggtgctccgggctttgcgggcccggtttcagagaagatatcaccaccc

SEQ ID NO: 345203 - DNA, 524 bp, Homo sapiens
agagctggagctgctacaggaaaagttttgtaatcttgaaatatgttcagcttttttgtaggtatgttcaggtttgatgagtctgggtcctatagtaaatctatttttagacagatcctgggagctaagattttgttgttgttgttttttgagacggagttttgctcttgttgcctaggctggagtgcaatggcataatctcagttcactgtaacctccacctcctagctactcaggaagctgaggcgggagaattgcttgaacccaggaggcagaggttgcagtgagctgagatcgtgccattccactccagcccgggcaacagagcgagactccatctcaaaaaaaaaaaaaaaaaaaaaaaaggaatgcagatgtctttaaaggtacaaaggtacagactaactacaaatctacttctttaccttagagacatgacctataaatgttggagtgcttattattccaagacatcttggaatacttatatacattctctgtgcatgtttgtgctggaatctatt

SEQ ID NO: 345204 - DNA, 975 bp, Homo sapiens
tggccctgacttctgaaaccagtgttctggggagaggcatttgagagtgacccaggcctgggaaccggggcttttctcggtggtcttaggcctgttctgcaaccaaggcaaggccaggatttccggaaatatgaggaaggctttgacccctactctatgttcaccccagagcagatcatggggaaggatgtccggctcctacgcatcaagaaggagggatccttagacctggccctggaaggcggtgtggactcccccattgggaaggtggtcgtttctgctgtgtatgagcggggagctgctgagcggcatggtggcattgtgaaaggggacgagatcatggcaatcaacggcaagattgtgacagactacaccctggctgaggctgacgctgccctgcagaaggcctggaatcagggcggggactggatcgaccttgtggttgccgtctgccccccaaaggagtatgacgatgagctgaccttcttctgaagtccaaaaggggaaaccaaattcaccgttaggaaacagtgagctccggccccacctcgtgaacacaaagcctcggaccagccttgagagaggccacactacacacaccagatggcatccttgggacctgaatctatcacccaggaatctcaaactccctttggccctgaaccagggccagataaggaacagctcgggccactcttctgaaggccaatgtggaggaaagggagcagccagccgtttgggagaagatctcaaggatccagactctcattcctttcctctggcccagtgaatttggtctctcccagctctgggggactccttccttgaaccctaataagaccccactggagtctctctctctccatccctctcctctgccctctgctctaattgctgccaggattgtcactccaaaccttactctgagctcattaataaaataaacagatttattttccagctaaaaaaaaaaaa

SEQ ID NO: 345205 - DNA, 1578 bp, Homo sapiens
cacaaagtcatgcattccttgggaacccagctcccatctgctgcccatggatgctctggctgagctgaactgtgtctcatcattttgttatctgtgtcttatagcttttggatggttttatcgttacgatggcaaattcccaaccatccggaaggtaggacagggttgggtgctgtgctggtgtgctgcttagtttgctgtgggttttggcttttcccaaacattccttgtcctatcaacactaaatggtgtgacttggcctgttcacttggaaggctaactccatctccatctttgtgtcaggctgacatcaaatggcagggtgctgttgcaaaggcaacattgggagagggatccatggtgtgagacctatccaagtaccatctggcagtgtgtgcatcagcactggccctgatgggaacaggaaaggggcaggaagcttctcctgtgtttctctgtcaagtagaactagagaccaaggccagaagcttggggtcagacagagcaaattatcggagtgggtgtacctagtgcatgttatgagaccagctgtgccagacgcagcctggctgacgaggtggggatttgctgcctcaggttgggacagagacccactccaagcacagccctctcctaggaatatctctgcatgtgcccaggataatgcatttttccaatctctaggacctttaattttctctctaaatcttattacaatatctccaggccttgtaaaactctcttgtccttatctttctaaatcacattgacatttgattgtgaaaacattgctgttaatatctataattggacattcgagatgacttggtatttggaggtcaggcagcagcataaatctgggtgagctaaattggatgttatcacttgaccagcgctttctggcaagacgtcagtcccccagaaaccagagcactggcagctgagtgaccttgatgatatataattctccctgcctgtaaaatgggaatattaactgtgccaggaaaatctacccccttcctccagcacattgctattaaaataacaaacagtaatatttttcctgacagaggttaatgcctttatctaggaacatatatcaagatttgtatagcattgaataaacttggaacagagttcctctgggaattccttcacacactgtcctggtctcagaaaggccttggtctcataagactatctgtttcccttgacaggctgactttggtggcttaggatgcctcattgggttagatttctaattcttctctatattctgcctctactagaactcagctagagaggacaaaacacacacacacacacacaagcacacacacacatgcacacataggattttacttgaaaaaaataataaaggagacagatatgtcaaatctttttcaggcactaataacatgtaaatgtaaaagaactagaatcttctccacataccacctcccatcagaaatcatgtccttgaaagtgctgttgataaagaaatagggttgcctttcccctattccttaatctaattattccagaaacagctgtcattttggttttcattttcacttc

SEQ ID NO: 345206 - DNA, 654 bp, Homo sapiens
ggctgatcctaggccatggggcccagaaatggggatggagtgccggggcagatgcaccatccaactgagtgtgccccagagtcacacggcttctccccacaggactggatcgaccttgtggttgccgtctgccccccaaaggagtatgacgatgagctgaccttcttctgaagtccaaaaggggaaaccaaattcaccgttaggaaacagtgagctccggccccacctcgtgaacacaaagcctcggaccagccttgagagaggccacactacacacaccagatggcatccttgggacctgaatctatcacccaggaatctcaaactccctttggccctgaaccagggccagataaggaacagctcgggccactcttctgaaggccaatgtggaggaaagggagcagccagccgtttgggagaagatctcaaggatccagactctcattcctttcctctggcccagtgaatttggtctctcccagctctgggggactccttccttgaaccctaataagaccccactggagtctctctctctccatccctctcctctgccctctgctctaattgctgccaggattgtcactccaaaccttactctgagctcattaataaaataaacagatttattttccagctaaaaaaaaaaaa

SEQ ID NO: 345207 - DNA, 2245 bp, Homo sapiens
gacagagtgaaggtcccctggcactgatgttacagaagaattcggtggtaaggggcttctggagagtggcatgtgctatctaagcgagtggcccaaatccttcctgaaagcatttatccggcactacagccaccatcaggtggattttctgattgaaaatgatgcagagaaggactatctctatgatgtgctgcgaatgtaccaccagaccatggacgtggccgtgctcgtgggagacctgaagctggtcatcaatgaacccagccgtctgcctctgtttgatgccattcggccgctgatcccactgaagcaccaggtggaatatgatcagctgaccccccggcgctccaggaagctgaaggaggtgcgtctggaccgtctgcaccccgaaggcctcggcctgagtgtgcgtggtggcctggagtttggctgtgggctcttcatctcccacctcatcaaaggcggtcaggcagacagcgtcgggctccaggtaggggacgagatcgtccggatcaatggatattccatctcctcctgtacccatgaggaggtcatcaacctcattcgaaccaagaaaactgtgtccatcaaagtgagacacatcggcctgatccccgtgaaaagctctcctgatgagcccctcacttggcagtatgtggatcagtttgtgtcggaatctgggggcgtgcgaggcagcctgggctcccctggaaatcgggaaaacaaggagaagaaggtcttcatcagcctggtaggctcccgaggccttggctgcagcatttccagcggccccatccagaagcctggcatctttatcagccatgtgaaacctggctccctgtctgctgaggtgggattggagataggggaccagattgtcgaagtcaatggcgtcgacttctctaacctggatcacaaggaggctgtaaatgtgctgaagagtagccgcagcctgaccatctccattgtagctgcagctggccgggagctgttcatgacagaccgggagcggctggcagaggcgcggcagcgtgagctgcagcggcaggagcttctcatgcagaagcggctggcgatggagtccaacaagatcctccaggagcagcaggagatggagcggcaaaggagaaaagaaattgcccagaaggcagcagaggaaaatgagagataccggaaggagatggaacagattgtagaggaggaagagaagtttaagaagcaatgggaagaagactggggctcaaaggaacagctactcttgcctaaaaccatcactgctgaggtacacccagtaccccttcgcaagccaaagtatgatcagggagtggaacctgagctcgagcccgcagatgacctggatggaggcacggaggagcagggagagcaggatttccggaaatatgaggaaggctttgacccctactctatgttcaccccagagcagatcatggggaaggatgtccggctcctacgcatcaagaaggagggatccttagacctggccctggaaggcggtgtggactcccccattgggaaggtggtcgtttctgctgtgtatgagcggggagctgctgagcggcatggtggcattgtgaaaggggacgagatcatggcaatcaacggcaagattgtgacagactacaccctggctgaggctgacgctgccctgcagaaggcctggaatcagggcggggactggatcgaccttgtggttgccgtctgccccccaaaggagtatgacgatgagctgaccttcttctgaagtccaaaaggggaaaccaaattcaccgttaggaaacagtgagctccggccccacctcgtgaacacaaagcctcggaccagccttgagagaggccacactacacacaccagatggcatccttgggacctgaatctatcacccaggaatctcaaactccctttggccctgaaccagggccagataaggaacagctcgggccactcttctgaaggccaatgtggaggaaagggagcagccagccgtttgggagaagatctcaaggatccagactctcattcctttcctctggcccagtgaatttggtctctcccagctctgggggactccttccttgaaccctaataagaccccactggagtctctctctctccatccctctcctctgccctctgctctaattgctgccaggattgtcactccaaaccttactctgagctcattaataaaataaacagatttattttccagctaaaaaaaaaaaa

SEQ ID NO: 345208 - DNA, 2171 bp, Homo sapiens
tttacgagctatcgtcgacccagcgctcgctgaaagcattgatccggcactacagccaccatcaggtggattttctgattgaaaatgatgcagagaaggactatctctatgatgtgctgcgaatgtaccaccagaccatggacgtggccgtgctcgtgggagacctgaagctggtcatcaatgaacccagccgtctgcctctgtttgatgccattcggccgctgatcccactgaagcaccaggtggaatatgatcagctgaccccccggcgctccaggaagctgaaggaggtgcgtctggaccgtctgcaccccgaaggcctcggcctgagtgtgcgtggtggcctggagtttggctgtgggctcttcatctcccacctcatcaaaggcggtcaggcagacagcgtcgggctccaggtaggggacgagatcgtccggatcaatggatattccatctcctcctgtacccatgaggaggtcatcaacctcattcgaaccaagaaaactgtgtccatcaaagtgagacacatcggcctgatccccgtgaaaagctctcctgatgagcccctcacttggcagtatgtggatcagtttgtgtcggaatctgggggcgtgcgaggcagcctgggctcccctggaaatcgggaaaacaaggagaagaaggtcttcatcagcctggtaggctcccgaggccttggctgcagcatttccagcggccccatccagaagcctggcatctttatcagccatgtgaaacctggctccctgtctgctgaggtgggattggagataggggaccagattgtcgaagtcaatggcgtcgacttctctaacctggatcacaaggaggctgtaaatgtgctgaagagtagccgcagcctgaccatctccattgtagctgcagctggccgggagctgttcatgacagaccgggagcggctggcagaggcgcggcagcgtgagctgcagcggcaggagcttctcatgcagaagcggctggcgatggagtccaacaagatcctccaggagcagcaggagatggagcggcaaaggagaaaagaaattgcccagaaggcagcagaggaaaatgagagataccggaaggagatggaacagattgtagaggaggaagagaagtttaagaagcaatgggaagaagactggggctcaaaggaacagctactcttgcctaaaaccatcactgctgaggtacacccagtaccccttcgcaagccaaagtatgatcagggagtggaacctgagctcgagcccgcagatgacctggatggaggcacggaggagcagggagagcaggatttccggaaatatgaggaaggctttgacccctactctatgttcaccccagagcagatcatggggaaggatgtccggctcctacgcatcaagaaggagggatccttagacctggccctggaaggcggtgtggactcccccattgggaaggtggtcgtttctgctgtgtatgagcggggagctgctgagcggcatggtggcattgtgaaaggggacgagatcatggcaatcaacggcaagattgtgacagactacaccctggctgaggctgacgctgccctgcagaaggcctggaatcagggcggggactggatcgaccttgtggttgccgtctgccccccaaaggagtatgacgatgagctgaccttcttctgaagtccaaaaggggaaaccaaattcaccgttaggaaacagtgagctccggccccacctcgtgaacacaaagcctcggaccagccttgagagaggccacactacacacaccagatggcatccttgggacctgaatctatcacccaggaatctcaaactccctttggccctgaaccagggccagataaggaacagctcgggccactcttctgaaggccaatgtggaggaaagggagcagccagccgtttgggagaagatctcaaggatccagactctcattcctttcctctggcccagtgaatttggtctctcccagctctgggggactccttccttgaaccctaataagaccccactggagtctctctctctccatccctctcctctgccctctgctctaattgctgccaggattgtcactccaaaccttactctgagctcattaataaaataaacagatttattttccagctaaaaaaaaaaaa

SEQ ID NO: 345209 - DNA, 1626 bp, Homo sapiens
agctccgagggcgcctggcccggtcgcggtcgcggctctttccagctcctggcagccgggcacccgaaggaacgggtcgtgcaacgacgcagctggacctggcccagccatggaccgaaaagtggcccgagaattccggcataaggtggattttctgattgaaaatgatgcagagaaggactatctctatgatgtgctgcgaatgtaccaccagaccatggacgtggccgtgctcgtgggagacctgaagctggtcatcaatgaacccagccgtctgcctctgtttgatgccattcggccgctgatcccactgaagcaccaggtggaatatgatcagctgaccccccggcgctccaggaagctgaaggaggtgcgtctggaccgtctgcaccccgaaggcctcggcctgagtgtgcgtggtggcctggagtttggctgtgggctcttcatctcccacctcatcaaaggcggtcaggcagacagcgtcgggctccaggtaggggacgagatcgtccggatcaatggatattccatctcctcctgtacccatgaggaggtcatcaacctcattcgaaccaagaaaactgtgtccatcaaagtgagacacatcggcctgatccccgtgaaaagctctcctgatgagcccctcacttggcagtatgtggatcagtttgtgtcggaatctgggggcgtgcgaggcagcctgggctcccctggaaatcgggaaaacaaggagaagaaggtcttcatcagcctggtaggctcccgaggccttggctgcagcatttccagcggccccatccagaagcctggcatctttatcagccatgtgaaacctggctccctgtctgctgaggtgggattggagataggggaccagattgtcgaagtcaatggcgtcgacttctctaacctggatcacaaggaggctgtaaatgtgctgaagagtagccgcagcctgaccatctccattgtagctgcagctggccgggagctgttcatgacagaccgggagcggctggcagaggcgcggcagcgtgagctgcagcggcaggagcttctcatgcagaagcggctggcgatggagtccaacaagatcctccaggagcagcaggagatggagcggcaaaggagaaaagaaattgcccagaaggcagcagaggaaaatgagagataccggaaggagatggaacagattgtagaggaggaagagaagtttaagaagcaatgggaagaagactggggctcaaaggaacagctactcttgcctaaaaccatcactgctgaggtacacccagtaccccttcgcaagccaaagtatgatcagggagtggaacctgagctcgagcccgcagatgacctggatggaggcacggaggagcagggagagcagcttttggatggttttatcgttacgatggcaaattcccaaccatccggaagagccgtgagagactctttgtctcccagcagctggaacgccaagtctccaggaaatgcaagtgggtatccatggccatgatatctgtgcataaattccccttatttaaaaatataaagattcagctcatgtctataatgccagcactgtgggaggccaagacaggcgaatcacgtgaggttggg

SEQ ID NO: 345210 - DNA, 2251 bp, Homo sapiens
agctccgagggcgcctggcccggtcgcggtcgcggctctttccagctcctggcagccgggcacccgaaggaacgggtcgtgcaacgacgcagctggacctggcccagccatggaccgaaaagtggcccgagaattccggcataaggtggattttctgattgaaaatgatgcagagaaggactatctctatgatgtgctgcgaatgtaccaccagaccatggacgtggccgtgctcgtgggagacctgaagctggtcatcaatgaacccagccgtctgcctctgtttgatgccattcggccgctgatcccactgaagcaccaggtggaatatgatcagctgaccccccggcgctccaggaagctgaaggaggtgcgtctggaccgtctgcaccccgaaggcctcggcctgagtgtgcgtggtggcctggagtttggctgtgggctcttcatctcccacctcatcaaaggcggtcaggcagacagcgtcgggctccaggtaggggacgagatcgtccggatcaatggatattccatctcctcctgtacccatgaggaggtcatcaacctcattcgaaccaagaaaactgtgtccatcaaagtgagacacatcggcctgatccccgtgaaaagctctcctgatgagcccctcacttggcagtatgtggatcagtttgtgtcggaatctgggggcgtgcgaggcagcctgggctcccctggaaatcgggaaaacaaggagaagaaggtcttcatcagcctggtaggctcccgaggccttggctgcagcatttccagcggccccatccagaagcctggcatctttatcagccatgtgaaacctggctccctgtctgctgaggtgggattggagataggggaccagattgtcgaagtcaatggcgtcgacttctctaacctggatcacaaggaggctgtaaatgtgctgaagagtagccgcagcctgaccatctccattgtagctgcagctggccgggagctgttcatgacagaccgggagcggctggcagaggcgcggcagcgtgagctgcagcggcaggagcttctcatgcagaagcggctggcgatggagtccaacaagatcctccaggagcagcaggagatggagcggcaaaggagaaaagaaattgcccagaaggcagcagaggaaaatgagagataccggaaggagatggaacagattgtagaggaggaagagaagtttaagaagcaatgggaagaagactggggctcaaaggaacagctactcttgcctaaaaccatcactgctgaggtacacccagtaccccttcgcaagccaaagtatgatcagggagtggaacctgagctcgagcccgcagatgacctggatggaggcacggaggagcagggagagcaggatttccggaaatatgaggaaggctttgacccctactctatgttcaccccagagcagatcatggggaaggatgtccggctcctacgcatcaagaaggagggatccttagacctggccctggaaggcggtgtggactcccccattgggaaggtggtcgtttctgctgtgtatgagcggggagctgctgagcggcatggtggcattgtgaaaggggacgagatcatggcaatcaacggcaagattgtgacagactacaccctggctgaggctgacgctgccctgcagaaggcctggaatcagggcggggactggatcgaccttgtggttgccgtctgccccccaaaggagtatgacgatgagctgaccttcttctgaagtccaaaaggggaaaccaaattcaccgttaggaaacagtgagctccggccccacctcgtgaacacaaagcctcggaccagccttgagagaggccacactacacacaccagatggcatccttgggacctgaatctatcacccaggaatctcaaactccctttggccctgaaccagggccagataaggaacagctcgggccactcttctgaaggccaatgtggaggaaagggagcagccagccgtttgggagaagatctcaaggatccagactctcattcctttcctctggcccagtgaatttggtctctcccagctctgggggactccttccttgaaccctaataagaccccactggagtctctctctctccatccctctcctctgccctctgctctaattgctgccaggattgtcactccaaaccttactctgagctcattaataaaataaacagatttattttccagctaaaaaaaaaaaa

SEQ ID NO: 345211 - DNA, 2177 bp, Homo sapiens
agctccgagggcgcctggcccggtcgcggtcgcggctctttccagctcctggcagccgggcacccgaaggaacgggtcgtgcaacgacgcagctggacctggcccagccatggaccgaaaagtggcccgagaattccggcataaggtggattttctgattgaaaatgatgcagagaaggactatctctatgatgtgctgcgaatgtaccaccagaccatggacgtggccgtgctcgtgggagacctgaagctggtcatcaatgaacccagccgtctgcctctgtttgatgccattcggccgctgatcccactgaagcaccaggtggaatatgatcagctgaccccccggcgctccaggaagctgaaggaggtgcgtctggaccgtctgcaccccgaaggcctcggcctgagtgtgcgtggtggcctggagtttggctgtgggctcttcatctcccacctcatcaaaggcggtcaggcagacagcgtcgggctccaggtaggggacgagatcgtccggatcaatggatattccatctcctcctgtacccatgaggaggtcatcaacctcattcgaaccaagaaaactgtgtccatcaaagtgagacacatcggcctgatccccgtgaaaagctctcctgatgagcccctcacttggcagtatgtggatcagtttgtgtcggaatctgggggcgtgcgaggcagcctgggctcccctggaaatcgggaaaacaaggagaagaaggtcttcatcagcctggtaggctcccgaggccttggctgcagcatttccagcggccccatccagaagcctggcatctttatcagccatgtgaaacctggctccctgtctgctgaggtgggattggagataggggaccagattgtcgaagtcaatggcgtcgacttctctaacctggatcacaaggaggctgtaaatgtgctgaagagtagccgcagcctgaccatctccattgtagctgcagctggccgggagctgttcatgacagaccgggagcggctggcagaggcgcggcagcgtgagctgcagcggcaggagcttctcatgcagaagcggctggcgatggagtccaacaagatcctccaggagcagcaggagatggagcggcaaaggagaaaagaaattgcccagaaggcagcagaggaaaatgagagataccggaaggagatggaacagattgtagaggaggaagagaagtttaagaagcaatgggaagaagactggggctcaaaggaacagctactcttgcctaaaaccatcactgctgaggtacacccagtaccccttcgcaagccaaagtgatttccggaaatatgaggaaggctttgacccctactctatgttcaccccagagcagatcatggggaaggatgtccggctcctacgcatcaagaaggagggatccttagacctggccctggaaggcggtgtggactcccccattgggaaggtggtcgtttctgctgtgtatgagcggggagctgctgagcggcatggtggcattgtgaaaggggacgagatcatggcaatcaacggcaagattgtgacagactacaccctggctgaggctgacgctgccctgcagaaggcctggaatcagggcggggactggatcgaccttgtggttgccgtctgccccccaaaggagtatgacgatgagctgaccttcttctgaagtccaaaaggggaaaccaaattcaccgttaggaaacagtgagctccggccccacctcgtgaacacaaagcctcggaccagccttgagagaggccacactacacacaccagatggcatccttgggacctgaatctatcacccaggaatctcaaactccctttggccctgaaccagggccagataaggaacagctcgggccactcttctgaaggccaatgtggaggaaagggagcagccagccgtttgggagaagatctcaaggatccagactctcattcctttcctctggcccagtgaatttggtctctcccagctctgggggactccttccttgaaccctaataagaccccactggagtctctctctctccatccctctcctctgccctctgctctaattgctgccaggattgtcactccaaaccttactctgagctcattaataaaataaacagatttattttccagctaaaaaaaaaaaa

SEQ ID NO: 345212 - DNA, 2294 bp, Homo sapiens
gtggtctgcataggtctgatgcattggggtcagaggggcagcctggcctgtggctcctcttctctcctcacaactccagccctgaaaagctgctggggaggcccttggggatgacctctcctccctgaggtctgctatgggggcgggtgctgagcctggagctgtgattctgctattggattttccaggtggattttctgattgaaaatgatgcagagaaggactatctctatgatgtgctgcgaatgtaccaccagaccatggacgtggccgtgctcgtgggagacctgaagctggtcatcaatgaacccagccgtctgcctctgtttgatgccattcggccgctgatcccactgaagcaccaggtggaatatgatcagctgaccccccggcgctccaggaagctgaaggaggtgcgtctggaccgtctgcaccccgaaggcctcggcctgagtgtgcgtggtggcctggagtttggctgtgggctcttcatctcccacctcatcaaaggcggtcaggcagacagcgtcgggctccaggtaggggacgagatcgtccggatcaatggatattccatctcctcctgtacccatgaggaggtcatcaacctcattcgaaccaagaaaactgtgtccatcaaagtgagacacatcggcctgatccccgtgaaaagctctcctgatgagcccctcacttggcagtatgtggatcagtttgtgtcggaatctgggggcgtgcgaggcagcctgggctcccctggaaatcgggaaaacaaggagaagaaggtcttcatcagcctggtaggctcccgaggccttggctgcagcatttccagcggccccatccagaagcctggcatctttatcagccatgtgaaacctggctccctgtctgctgaggtgggattggagataggggaccagattgtcgaagtcaatggcgtcgacttctctaacctggatcacaaggaggctgtaaatgtgctgaagagtagccgcagcctgaccatctccattgtagctgcagctggccgggagctgttcatgacagaccgggagcggctggcagaggcgcggcagcgtgagctgcagcggcaggagcttctcatgcagaagcggctggcgatggagtccaacaagatcctccaggagcagcaggagatggagcggcaaaggagaaaagaaattgcccagaaggcagcagaggaaaatgagagataccggaaggagatggaacagattgtagaggaggaagagaagtttaagaagcaatgggaagaagactggggctcaaaggaacagctactcttgcctaaaaccatcactgctgaggtacacccagtaccccttcgcaagccaaagtatgatcagggagtggaacctgagctcgagcccgcagatgacctggatggaggcacggaggagcagggagagcaggatttccggaaatatgaggaaggctttgacccctactctatgttcaccccagagcagatcatggggaaggatgtccggctcctacgcatcaagaaggagggatccttagacctggccctggaaggcggtgtggactcccccattgggaaggtggtcgtttctgctgtgtatgagcggggagctgctgagcggcatggtggcattgtgaaaggggacgagatcatggcaatcaacggcaagattgtgacagactacaccctggctgaggctgacgctgccctgcagaaggcctggaatcagggcggggactggatcgaccttgtggttgccgtctgccccccaaaggagtatgacgatgagctgaccttcttctgaagtccaaaaggggaaaccaaattcaccgttaggaaacagtgagctccggccccacctcgtgaacacaaagcctcggaccagccttgagagaggccacactacacacaccagatggcatccttgggacctgaatctatcacccaggaatctcaaactccctttggccctgaaccagggccagataaggaacagctcgggccactcttctgaaggccaatgtggaggaaagggagcagccagccgtttgggagaagatctcaaggatccagactctcattcctttcctctggcccagtgaatttggtctctcccagctctgggggactccttccttgaaccctaataagaccccactggagtctctctctctccatccctctcctctgccctctgctctaattgctgccaggattgtcactccaaaccttactctgagctcattaataaaataaacagatttattttccagctaaaaaaaaaaaa

SEQ ID NO: 345213 - DNA, 1839 bp, Homo sapiens
  misc_feature (2)..(3): n is a, c, g, or t
  misc_feature (29)..(29): n is a, c, g, or t
  misc_feature (36)..(36): n is a, c, g, or t
  misc_feature (49)..(50): n is a, c, g, or t
  misc_feature (70)..(70): n is a, c, g, or t
tnnctcgggccatttccggtccagaatgntcaaggnccagctgagtcgnngcacgacccgttccttcggntgcccggatgccaggtaggggacgagatcgtccggatcaatggatattccatctcctcctgtacccatgaggaggtcatcaacctcattcgaaccaagaaaactgtgtccatcaaagtgagacacatcggcctgatccccgtgaaaagctctcctgatgagcccctcacttggcagtatgtggatcagtttgtgtcggaatctgggggcgtgcgaggcagcctgggctcccctggaaatcgggaaaacaaggagaagaaggtcttcatcagcctggtaggctcccgaggccttggctgcagcatttccagcggccccatccagaagcctggcatctttatcagccatgtgaaacctggctccctgtctgctgaggtgggattggagataggggaccagattgtcgaagtcaatggcgtcgacttctctaacctggatcacaaggaggctgtaaatgtgctgaagagtagccgcagcctgaccatctccattgtagctgcagctggccgggagctgttcatgacagaccgggagcggctggcagaggcgcggcagcgtgagctgcagcggcaggagcttctcatgcagaagcggctggcgatggagtccaacaagatcctccaggagcagcaggagatggagcggcaaaggagaaaagaaattgcccagaaggcagcagaggaaaatgagagataccggaaggagatggaacagattgtagaggaggaagagaagtttaagaagcaatgggaagaagactggggctcaaaggaacagctactcttgcctaaaaccatcactgctgaggtacacccagtaccccttcgcaagccaaagtatgatcagggagtggaacctgagctcgagcccgcagatgacctggatggaggcacggaggagcagggagagcaggatttccggaaatatgaggaaggctttgacccctactctatgttcaccccagagcagatcatggggaaggatgtccggctcctacgcatcaagaaggagggatccttagacctggccctggaaggcggtgtggactcccccattgggaaggtggtcgtttctgctgtgtatgagcggggagctgctgagcggcatggtggcattgtgaaaggggacgagatcatggcaatcaacggcaagattgtgacagactacaccctggctgaggctgacgctgccctgcagaaggcctggaatcagggcggggactggatcgaccttgtggttgccgtctgccccccaaaggagtatgacgatgagctgaccttcttctgaagtccaaaaggggaaaccaaattcaccgttaggaaacagtgagctccggccccacctcgtgaacacaaagcctcggaccagccttgagagaggccacactacacacaccagatggcatccttgggacctgaatctatcacccaggaatctcaaactccctttggccctgaaccagggccagataaggaacagctcgggccactcttctgaaggccaatgtggaggaaagggagcagccagccgtttgggagaagatctcaaggatccagactctcattcctttcctctggcccagtgaatttggtctctcccagctctgggggactccttccttgaaccctaataagaccccactggagtctctctctctccatccctctcctctgccctctgctctaattgctgccaggattgtcactccaaaccttactctgagctcattaataaaataaacagatttattttccagctaaaaaaaaaaaa

SEQ ID NO: 345214 - DNA, 928 bp, Homo sapiens
cccctactcctcggctctgaccctcaagaccctctgctgtgttgccctaaagccctccctttgcttccaggatttccggaaatatgaggaaggctttgacccctactctatgttcaccccagagcagatcatggggaaggatgtccggctcctacgcatcaagaaggagggatccttagacctggccctggaaggcggtgtggactcccccattgggaaggtggtcgtttctgctgtgtatgagcggggagctgctgagcggcatggtggcattgtgaaaggggacgagatcatggcaatcaacggcaagattgtgacagactacaccctggctgaggctgacgctgccctgcagaaggcctggaatcagggcggggactggatcgaccttgtggttgccgtctgccccccaaaggagtatgacgatgagctgaccttcttctgaagtccaaaaggggaaaccaaattcaccgttaggaaacagtgagctccggccccacctcgtgaacacaaagcctcggaccagccttgagagaggccacactacacacaccagatggcatccttgggacctgaatctatcacccaggaatctcaaactccctttggccctgaaccagggccagataaggaacagctcgggccactcttctgaaggccaatgtggaggaaagggagcagccagccgtttgggagaagatctcaaggatccagactctcattcctttcctctggcccagtgaatttggtctctcccagctctgggggactccttccttgaaccctaataagaccccactggagtctctctctctccatccctctcctctgccctctgctctaattgctgccaggattgtcactccaaaccttactctgagctcattaataaaataaacagatttattttccagctaaaaaaaaaaaa

SEQ ID NO: 345215 - DNA, 490 bp, Homo sapiens
agacaaggtcatactatgttgcgcaggctggtctcgaactcctagccttgatcctcctgcttcagcttcccaaagtgctgggattacaagcatgagccactgtgcccagctgtatactggatatctgagacttggtaccaaaaaaaaaaataattaagaaagtaagttaatattttcatattgatttcatgttgaatattgggaatatattgagttaaaatgtattactaaaattaatttcacctgtttctatttactttttaatgtgtctattagaaacatttaaattacgtggatggttcacattacatttccattggaaaacatcataatttatgagaaactttgctgtttgaaattttatcaatgagaatgaaatatctcactcctacttgaaagatctgagccatatgggtcactttgacataggagagttgcctcaatttccaacccagagcttcagataaaaggtttttaaactgtaatttcc

SEQ ID NO: 345216 - DNA, 366 bp, Homo sapiens
aggcgccagccaccatgcccggataatttttttgtatttttagtagggacggggtttcaccgtgttagccaggatggtctcaatctcctgacctcgtgatccgcccgcctcggcctcccaaagtgctgggattacaggcgtgagccaccgtgcccagcctcatcattttcttataaagatacaagtcctattggattgctgtcccacccttatgaccttatttgtgtgtgtgtgtgtgtgtgtgtgtgtgtgtattttttgagacagggtctcgctctttccacgttggagtgcagtggtgcaatcctagctcagtgcaccctcaaactcctgggctcacaccttagcctgcaatcaagcctggaa

SEQ ID NO: 345217 - DNA, 244 bp, Homo sapiens
agtggggaaagaggaagtgacagatgatgttaagcattttctaacaacatacaaaagtagttaagagagggatggaagaaataggaagatgatgttggccaaagagtacaaagtttcaggtttattttttatttttattttgttaaattgagacagagtctcactctgtcgcccaggctggagtgcagtggtgtgatctcagctcactgcttctctgcctcaagggttcaagtgattctcctgc

SEQ ID NO: 345218 - DNA, 672 bp, Homo sapiens
tagagacggggtttcaccacgttggccaggctggtctcaaactcctgaacctcaagtgatccacctgcctcggcctcccaaagtgctgggattacagatgtgagccaccaccttcactacctttcccacatggatggagcaaatactctcagaagaagaatggagcccatgtgttcttccagagcccgtacatagcatcagctgacctccttcttttcttatactcactccatcctgctgtaactcagtctatgactgaacatgagatgtccaactctctaattgtagctgagaagagaaaacaaacaggtattaggcacagttataaaagggaggtaaccccactatatcagagaaaaattattgggatagagcagctcagattgagcatagtatcatgagaagaaatggcaacacaaagatggaaacatactctagctgcaataaacacaagtatgaacaaaaataaaaagtaacagtaatccagtctgggaggcaccatgacaatgacccagaacaaaagaaaattcctcacaagagctctgcgttatttagcaacttcataaaggtgacaatcacatggtgtctcagggaagagatgacagatagtaatgaggatgctgcagagtaaataagacaaattaaggatcagaccaacacatgacagaacca

SEQ ID NO: 345219 - DNA, 883 bp, Homo sapiens
tgtccttttggttgttaagaggctgcaatggcccatgaatgcccaggctcagaagagctgcacacaagcctcttaaaatctgaaacattcactgtctgctgcttgtctttacagcaatctttgttaaccatgttatttccagataggaatccaagctcaataaagtggcctgaagaataggcttttgcctctactgtggtttggctccaaatcgggttgccattggtcaaaacataacttccatttggtcccagcaggttcctggactcttccctgctgtggggggtgggtccctcgccactctccagaattcagagggggtcctctctccacaggtgacctgccgagccattgggattggggcctacttggtgaggctgggccagcgagtgatccaggtggagaattcccacatcatcctcacaggagcaagtgctctcaacaaggtgaccaaaaaggggcctgtgcagagtggatccttgggggccaggagtcattttaacattcccattggtctctggtgggggatttttctcaatatgaagccagtttcattcctactgatacaagagctctttttttccaatttgcagctatctgggtccttatgagaaaaaaaaaattagttttaggcaattctggtcgatctaactccctgtattactgacattttaaaacaaattattgaagtgccattacacattgcagaaaattagaaaaggaaccccccaaaaaagtaattttgcagcttctatcattctggtatagttccctctcatcttctgtctttatgtggttaatttatagtgaatatgcagttttgtattctacttttttcactgtattaaaacattttccttgttgaaaagtctctatacttaat

SEQ ID NO: 345220 - DNA, 9340 bp, Homo sapiens
atggtcttgcttctttgtctatcttgtctgattttctcctgtctgaccttttcctggttaaaaatctgggagaaaatgacggactccaagccgatcaccaagagtaaatcagaagcaaacctcatcccgagccaggagccctttccagcctctgataactcaggggagacaccgcagagaaatggggagggccacactctgcacaaagacacccagccaggccgagcccagcctcccacaaaggcccaaagatccggtcggcggagaaactccctaccaccctcccgccagaagcccccaagaaaccccctttcttccagtgacgcagcaccctccccagagcttcaagccaacgggactgggacacaaggtctggaggccacagataccaatggcctgtcctcctcagccaggccccagggcagcaagctggtcccctccaaagaagacaagaagcaggcaaacatcaagaggcagctgatgaccaacttcatcctgggctcttttgatgactactcctccgacgaggactctgttgctggctcatctcgtgagtctacccggaagggcagccgggccagcttgggggccctgtccctggaggcttatctgaccacaggtgaagctgagacccgcgtccccactatgaggccgagcatgtcgggactccacctggtgaagaggggacgggaacacaagaagctggacctgcacagagactttaccgtggcttctcccgctgagtttgtcacacgctttgggggggatcgggtcatcgagaaggtgcttattgccaacaacgggattgccgctgtgaagtgcatgcgctccatccgcaggtgggcctatgagatgttccgcaacgagcgggccatccggtttgttcgcatggtgacccccgaggaccttaaggccaacgcagagtacatcaagatggcggatcattacgggcccgccccaggagggcccaataacaacaactatgccaacgtggagctgattgtggacattgccaagagaatcccgttgcaggcggtgtgggctggctggggccatgctttagaaaaccctaaacttccggagctgctgtgcaagaatggagttgctttcttaggccctcccaggttgaggccaatggtgggtctaggagataagatcgcctccaccgttgtcgcccagacgctacaggtcccaaccctgcccaggagtggaagcgccctgacagtggagtggacagaagatgatctgcagcagggaaaaagaatcagtgtcccagaagatgtttatgacaagggttgcgtgaaagacgtagatgagggcttggaggcagcagaaagaattggttttccattgatgatcaaagcttctgaaggtggcggagggaagggaatccgggaaactgagagtgcggaggacttcccgatccttttcagacaagtacagagtgagatcccaggctcgcccatctttctcatgaagctggcccagcacgcccgtcacctggaagttcagatcctcgctgaccagtatgggaatgctgtgtctctgtttggtcgcgactgctccatccagcggcggcatcagaagatcgttgaggaagcaccggccaccatcgcgccgctggccatattcgagttcatggagcagtgtgccattcgcctggccaagaccgtgggctatgtgagtgcagggacagtggaatacctctatagtcaggatggtagcttccacttcttggagctgaatcctcgcttgcaggtggaacatccctgcacagaaatgattgctgacgttaatctgccggccgcccagctacagatcgccatgggtgccccactgcaccggctgaaagatatccggcttctgtatggagagtcaccctggggagactccccaatttcttttgaaaactcagctcatctcccctgcccccgaggccacgtcattgccaccagaatcaccagcgaaaacccagacgagggttttaagccgagctccgggactgtccaggaactgaatttccggagcagcaagaacgtctggggttacttcacggtggccgctactggaggcctgcacgagtttgcgatttcccagtttgggcactgcttctcctggggagagaaccggaaagaggccatttcgaacatggtggtggctttgaaggaactgtccatccgaggcgactttaggactaccgtggaatacctcattaacctcctggagaccgagagcttccagaacaacgacatcgacaccgggtggttggactacctcattgctgagaaagtgcaaaagaaaccgaatatcatgcttggggtggtatgcggggcccttgaacgtggagatgcgatgttcagaacgtgcatgacagatttcttacactccctggaaaggggccaggtcctcccagcggattcactactgaacctcgtagatgtggaattaatttacgagggtgtaaagtacattctaaaggtgacccggcagtctctgaccatgttcgttctcatcatgaatggctgccacatcgagattgatgcccaccggctgaatgatggggggctcctgctctcctacaatgggaacagctacaccacctacatgaaggaagaggttgacagttaccgaattaccatcggcaataagacgtgtgtttttgagaaggagaacgatcctacagtcctgagatccccctcggctgggaagctgacacagtatcacagtggaggatgggggccacgttgaggctgggagcacgctacgctgagatggaggtgatgaagatgatcatgaccctgaacgttcaggaaagaggccgggtgaagtacatcaagcgtccaggtgcggtgctggaagcaggctgcgtggtggccaggctggagctcgatgacccttctaaagtccacccggctgaaccgttcacaggagaactccctgcccagcagaacactgccgatcctcggaaagaaactgcaccagggtcttccacagcgtcctgggaagcctcaccaacgtcatgagtggcttttgtctgccagagccgttttttagcataaagctgaaggagtgggtgcagaagctcatgatgaccctccggcacccgtcactgctgctggacgtgcaggagatcatgaccagtcgtgcaggccgcatccccccccctgttgagaagtctgtccgcaaggtgatggcccagtatgccagcaacatcacctcggtgctgtgccagttccccagccagcagatagccaccatcctggactgccatgcagccaccctgcagcggaaggctgatcgagaggtcttcttcatcaacacccagagcatggtgcagttggtccagaggtaccgaagtggaatccgcggctcatatgaaaacagtggtgatcgatctcttgagaagatacttgcgtgttgagcaccattttcggcaaggcaagagatgctgatgccaactccagtgggatggtggggggcgtgaggagcctgagctttacctctgtgtgggtggttttgtctcccccagcccactacgacaagtgtgtgataaacctcagggaacagttcaagccagacatgtcccaggtgctggactgcatcttctcccacgcacaggtggccaagaagaaccagctggtgatcatgttgatcgatgagctgtgtggcccagacccttccctgtcggacgagctgatctccatcctcaacgagctcactcagctgagcaaaagcgagcactgcaaagtggccctcagagcccggcagatcctgatcgcctccacctcccctcctacgagctgcggcataaccaggtggagtccattttcctgtctgccattgacatgtacggccaccagttctgccccgagaacctccagaaattaatactttcggaaacaaccatcttcgacgtcctgaatactttcttctatcacgcaaacaaagtcgtgtgcatggcgtccttggaggtttacgtggggggggcttacatcgcctatgtgttaaacagcctgcagcaccggcagctcccggacggcacctgcgtggtagaattccagttcatgctgccgtcctcccacccaaaccggatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaactcaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaatcaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccatcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaataaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgtaagtaagcatctcatatatttcagccaaataaatgggccaagggaaaaaaatatatatatatagacaggactagagaaaacctatttttgtaatgatgtttctttggatactgtctagtcacccagaaaaatgtatggatgaatttttttttttttttttgagacaaagtctcactgtgtcatgcaggctggagtgcagtggcatgatctcactgcaacctccatctcctgtctcagcctcctagataactgggattacaggtgcccaccaccatgcccggctaatttttgtatttttggtagagacagagtttcaccaggttggtcaggctggtctcaaactcttgacttcaggtaatccacccaccttggcctcccaaagtgctgggattacaggcatgagccaccatcttcagccagatgatttttttattgagagagtgaaatgctattttgttccccaaatggcgctagtgaatcactaggagggtcccactgataggccatgtttagcactggttgccagggattctctttttgagagagggaaagcaaaatgaatggaagtacccagctggaggtttcagggcttctggaggatgctctcgcatagctcgaggtcctctgcccacctcttctctccaaggaaaatgaggactgccccttccccctgcaggattggcccccagcctgcgcatgcaccctcctcttgcccaagtggggagcacagaggcggagaggaatcccttaccacacccacggcccagcttgctcacgagtgtcacctctgtgacggtcaccactgctcccttggagggccacttgagttactgttgcttcctcgcctgctggcttgatgagcaccgatggtgggatctgaccccgaggggcagagctgtcggtgactgaggactggactgtggtgaccatgccgatttgctcagggagaacgttgcaatgcacccagcagctcctggctctgcaggcggcacagcctggggccctgtgatcctctggtttcttccattggggcggagtcgggggtggagggagctggccacaacccactgctctgatgggtggtttgtccaaggatgctgaatgtaatgcctggtcaatgtggaagcccatgaggttgcccagggaagcctccaaaagctgggatgcttgagggtatccaagttgaaaaagacaaaatctgaccatcagccagtgacagtcctggcaaatgaaggtggggcggggcagtgaggggtgggagaaggtgaatgattcattattccaccccgaggtttgctggggtgaggggaagaatcgatgctgctttgggaactgaaggtttttctgttgggaaggccctcttggttttggagagaaagacaagttatgagtagctgctaccctggaacggtgggcagagagcctactaggaaatgtgcagaataaactattttttgaaggaaaactttggcct

SEQ ID NO: 345221 - DNA, 9036 bp, Homo sapiens
atggtcttgcttctttgtctatcttgtctgattttctcctgtctgaccttttcctggttaaaaatctgggagaaaatgacggactccaagccgatcaccaagagtaaatcagaagcaaacctcatcccgagccaggagccctttccagcctctgataactcaggggagacaccgcagagaaatggggagggccacactctgcacaaagacacccagccaggccgagcccagcctcccacaaaggcccaaagatccggtcggcggagaaactccctaccaccctcccgccagaagcccccaagaaaccccctttcttccagtgacgcagcaccctccccagagcttcaagccaacgggactgggacacaaggtctggaggccacagataccaatggcctgtcctcctcagccaggccccagggcagcaagctggtcccctccaaagaagacaagaagcaggcaaacatcaagaggcagctgatgaccaacttcatcctgggctcttttgatgactactcctccgacgaggactctgttgctggctcatctcgtgagtctacccggaagggcagccgggccagcttgggggccctgtccctggaggcttatctgaccacaggtgaagctgagacccgcgtccccactatgaggccgagcatgtcgggactccacctggtgaagaggggacgggaacacaagaagctggacctgcacagagactttaccgtggcttctcccgctgagtttgtcacacgctttgggggggatcgggtcatcgagaaggtgcttattgccaacaacgggattgccgctgtgaagtgcatgcgctccatccgcaggtgggcctatgagatgttccgcaacgagcgggccatccggtttgttcgcatggtgacccccgaggaccttaaggccaacgcagagtacatcaagatggcggatcattacgggcccgccccaggagggcccaataacaacaactatgccaacgtggagctgattgtggacattgccaagagaatcccgttgcaggcggtgtgggctggctggggccatgctttagaaaaccctaaacttccggagctgctgtgcaagaatggagttgctttcttaggccctcccaggttgaggccaatggtgggtctaggagataagatcgcctccaccgttgtcgcccagacgctacaggtcccaaccctgcccaggagtggaagcgccctgacagtggagtggacagaagatgatctgcagcagggaaaaagaatcagtgtcccagaagatgtttatgacaagggttgcgtgaaagacgtagatgagggcttggaggcagcagaaagaattggttttccattgatgatcaaagcttctgaaggtggcggagggaagggaatccgggaaactgagagtgcggaggacttcccgatccttttcagacaagtacagagtgagatcccaggctcgcccatctttctcatgaagctggcccagcacgcccgtcacctggaagttcagatcctcgctgaccagtatgggaatgctgtgtctctgtttggtcgcgactgctccatccagcggcggcatcagaagatcgttgaggaagcaccggccaccatcgcgccgctggccatattcgagttcatggagcagtgtgccattcgcctggccaagaccgtgggctatgtgagtgcagggacagtggaatacctctatagtcaggatggtagcttccacttcttggagctgaatcctcgcttgcaggtggaacatccctgcacagaaatgattgctgacgttaatctgccggccgcccagctacagatcgccatgggtgccccactgcaccggctgaaagatatccggcttctgtatggagagtcaccctggggagactccccaatttcttttgaaaactcagctcatctcccctgcccccgaggccacgtcattgccaccagaatcaccagcgaaaacccagacgagggttttaagccgagctccgggactgtccaggaactgaatttccggagcagcaagaacgtctggggttacttcacggtggccgctactggaggcctgcacgagtttgcgatttcccagtttgggcactgcttctcctggggagagaaccggaaagaggccatttcgaacatggtggtggctttgaaggaactgtccatccgaggcgactttaggactaccgtggaatacctcattaacctcctggagaccgagagcttccagaacaacgacatcgacaccgggtggttggactacctcattgctgagaaagtgcaaaagaaaccgaatatcatgcttggggtggtatgcggggcccttgaacgtggagatgcgatgttcagaacgtgcatgacagatttcttacactccctggaaaggggccaggtcctcccagcggattcactactgaacctcgtagatgtggaattaatttacgagggtgtaaagtacattctaaaggtgacccggcagtctctgaccatgttcgttctcatcatgaatggctgccacatcgagattgatgcccaccggctgaatgatggggggctcctgctctcctacaatgggaacagctacaccacctacatgaaggaagaggttgacagttaccgaattaccatcggcaataagacgtgtgtttttgagaaggagaacgatcctacagtcctgagatccccctcggctgggaagctgacacagtatcacagtggaggatgggggccacgttgaggctgggagcacgctacgctgagatggaggtgatgaagatgatcatgaccctgaacgttcaggaaagaggccgggtgaagtacatcaagcgtccaggtgcggtgctggaagcaggctgcgtggtggccaggctggagctcgatgacccttctaaagtccacccggctgaaccgttcacaggagaactccctgcccagcagaacactgccgatcctcggaaagaaactgcaccagggtcttccacagcgtcctgggaagcctcaccaacgtcatgagtggcttttgtctgccagagccgttttttagcataaagctgaaggagtgggtgcagaagctcatgatgaccctccggcacccgtcactgctgctggacgtgcaggagatcatgaccagtcgtgcaggccgcatccccccccctgttgagaagtctgtccgcaaggtgatggcccagtatgccagcaacatcacctcggtgctgtgccagttccccagccagcagatagccaccatcctggactgccatgcagccaccctgcagcggaaggctgatcgagaggtcttcttcatcaacacccagagcatggtgcagttggtccagaggtaccgaagtggaatccgcggctcatatgaaaacagtggtgatcgatctcttgagaagatacttgcgtgttgagcaccattttcggcaaggcaagagatgctgatgccaactccagtgggatggtggggggcgtgaggagcctgagctttacctctgtgtgggtggttttgtctcccccagcccactacgacaagtgtgtgataaacctcagggaacagttcaagccagacatgtcccaggtgctggactgcatcttctcccacgcacaggtggccaagaagaaccagctggtgatcatgttgatcgatgagctgtgtggcccagacccttccctgtcggacgagctgatctccatcctcaacgagctcactcagctgagcaaaagcgagcactgcaaagtggccctcagagcccggcagatcctgatcgcctccacctcccctcctacgagctgcggcataaccaggtggagtccattttcctgtctgccattgacatgtacggccaccagttctgccccgagaacctccagaaattaatactttcggaaacaaccatcttcgacgtcctgaatactttcttctatcacgcaaacaaagtcgtgtgcatggcgtccttggaggtttacgtggggggggcttacatcgcctatgtgttaaacagcctgcagcaccggcagctcccggacggcacctgcgtggtagaattccagttcatgctgccgtcctcccacccaaaccggatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaactcaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaatcaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccatcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaataaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgtaagtaagcatctcatatatttcagccaaataaatgggccaagggaaaaaaatatatatatatagacaggactagagaaaacctatttttgtaatgatgtttctttggatactgtctagtcacccagaaaaatgtatggatgaatttttttttttttttttgagacaaagtctcactgtgtcatgcaggctggagtgcagtggcatgatctcactgcaacctccatctcctgtctcagcctcctagataactgggattacaggtgcccaccaccatgcccggctaatttttgtatttttggtagagacagagtttcaccaggttggtcaggctggtctcaaactcttgacttcaggtaatccacccaccttggcctcccaaagtgctgggattacaggcatgagccaccatcttcagccagatgatttttttattgagagagtgaaatgctattttgttccccaaatggcgctagtgaatcactaggagggtcccactgataggccatgtttagcactggttgccagggattctctttttgagagagggaaagcaaaatgaatggaagtacccagctggaggtttcagggcttctggaggatgctctcgcatagctcgaggtcctctgcccacctcttctctccaaggaaaatgaggactgccccttccccctgcaggattggcccccagcctgcgcatgcaccctcctcttgcccaagtggggagcacagaggcggagaggaatcccttaccacacccacggcccagcttgctcacgagtgtcacctctgtgacggtcaccactgctcccttggagggccacttgagttactgttgcttcctcgcctgctggcttgatgagcaccgatggtgggatctgaccccgaggggcagagctgtcggtgactgaggactggactgtggtgaccatgccgatttgctcagtgaggggtgggagaaggtgaatgattcattattccaccccgaggtttgctggggtgaggggaagaatcgatgctgctttgggaactgaaggtttttctgttgggaaggccctcttggttttggagagaaagacaagttatgagtagctgctaccctggaacggtgggcagagagcctactaggaaatgtgcagaataaactattttttgaaggaaaactttggcct

SEQ ID NO: 345222 - DNA, 8488 bp, Homo sapiens
atggtcttgcttctttgtctatcttgtctgattttctcctgtctgaccttttcctggttaaaaatctgggagaaaatgacggactccaagccgatcaccaagagtaaatcagaagcaaacctcatcccgagccaggagccctttccagcctctgataactcaggggagacaccgcagagaaatggggagggccacactctgcacaaagacacccagccaggccgagcccagcctcccacaaaggcccaaagatccggtcggcggagaaactccctaccaccctcccgccagaagcccccaagaaaccccctttcttccagtgacgcagcaccctccccagagcttcaagccaacgggactgggacacaaggtctggaggccacagataccaatggcctgtcctcctcagccaggccccagggcagcaagctggtcccctccaaagaagacaagaagcaggcaaacatcaagaggcagctgatgaccaacttcatcctgggctcttttgatgactactcctccgacgaggactctgttgctggctcatctcgtgagtctacccggaagggcagccgggccagcttgggggccctgtccctggaggcttatctgaccacaggtgaagctgagacccgcgtccccactatgaggccgagcatgtcgggactccacctggtgaagaggggacgggaacacaagaagctggacctgcacagagactttaccgtggcttctcccgctgagtttgtcacacgctttgggggggatcgggtcatcgagaaggtgcttattgccaacaacgggattgccgctgtgaagtgcatgcgctccatccgcaggtgggcctatgagatgttccgcaacgagcgggccatccggtttgttcgcatggtgacccccgaggaccttaaggccaacgcagagtacatcaagatggcggatcattacgggcccgccccaggagggcccaataacaacaactatgccaacgtggagctgattgtggacattgccaagagaatcccgttgcaggcggtgtgggctggctggggccatgctttagaaaaccctaaacttccggagctgctgtgcaagaatggagttgctttcttaggccctcccaggttgaggccaatggtgggtctaggagataagatcgcctccaccgttgtcgcccagacgctacaggtcccaaccctgcccaggagtggaagcgccctgacagtggagtggacagaagatgatctgcagcagggaaaaagaatcagtgtcccagaagatgtttatgacaagggttgcgtgaaagacgtagatgagggcttggaggcagcagaaagaattggttttccattgatgatcaaagcttctgaaggtggcggagggaagggaatccgggaaactgagagtgcggaggacttcccgatccttttcagacaagtacagagtgagatcccaggctcgcccatctttctcatgaagctggcccagcacgcccgtcacctggaagttcagatcctcgctgaccagtatgggaatgctgtgtctctgtttggtcgcgactgctccatccagcggcggcatcagaagatcgttgaggaagcaccggccaccatcgcgccgctggccatattcgagttcatggagcagtgtgccattcgcctggccaagaccgtgggctatgtgagtgcagggacagtggaatacctctatagtcaggatggtagcttccacttcttggagctgaatcctcgcttgcaggtggaacatccctgcacagaaatgattgctgacgttaatctgccggccgcccagctacagatcgccatgggtgccccactgcaccggctgaaagatatccggcttctgtatggagagtcaccctggggagactccccaatttcttttgaaaactcagctcatctcccctgcccccgaggccacgtcattgccaccagaatcaccagcgaaaacccagacgagggttttaagccgagctccgggactgtccaggaactgaatttccggagcagcaagaacgtctggggttacttcacggtggccgctactggaggcctgcacgagtttgcgatttcccagtttgggcactgcttctcctggggagagaaccggaaagaggccatttcgaacatggtggtggctttgaaggaactgtccatccgaggcgactttaggactaccgtggaatacctcattaacctcctggagaccgagagcttccagaacaacgacatcgacaccgggtggttggactacctcattgctgagaaagtgcaaaagaaaccgaatatcatgcttggggtggtatgcggggcccttgaacgtggagatgcgatgttcagaacgtgcatgacagatttcttacactccctggaaaggggccaggtcctcccagcggattcactactgaacctcgtagatgtggaattaatttacgagggtgtaaagtacattctaaaggtgacccggcagtctctgaccatgttcgttctcatcatgaatggctgccacatcgagattgatgcccaccggctgaatgatggggggctcctgctctcctacaatgggaacagctacaccacctacatgaaggaagaggttgacagttaccgaattaccatcggcaataagacgtgtgtttttgagaaggagaacgatcctacagtcctgagatccccctcggctgggaagctgacacagtatcacagtggaggatgggggccacgttgaggctgggagcacgctacgctgagatggaggtgatgaagatgatcatgaccctgaacgttcaggaaagaggccgggtgaagtacatcaagcgtccaggtgcggtgctggaagcaggctgcgtggtggccaggctggagctcgatgacccttctaaagtccacccggctgaaccgttcacaggagaactccctgcccagcagaacactgccgatcctcggaaagaaactgcaccagggtcttccacagcgtcctgggaagcctcaccaacgtcatgagtggcttttgtctgccagagccgttttttagcataaagctgaaggagtgggtgcagaagctcatgatgaccctccggcacccgtcactgctgctggacgtgcaggagatcatgaccagtcgtgcaggccgcatccccccccctgttgagaagtctgtccgcaaggtgatggcccagtatgccagcaacatcacctcggtgctgtgccagttccccagccagcagatagccaccatcctggactgccatgcagccaccctgcagcggaaggctgatcgagaggtcttcttcatcaacacccagagcatggtgcagttggtccagaggtaccgaagtggaatccgcggctcatatgaaaacagtggtgatcgatctcttgagaagatacttgcgtgttgagcaccattttcggcaaggcaagagatgctgatgccaactccagtgggatggtggggggcgtgaggagcctgagctttacctctgtgtgggtggttttgtctcccccagcccactacgacaagtgtgtgataaacctcagggaacagttcaagccagacatgtcccaggtgctggactgcatcttctcccacgcacaggtggccaagaagaaccagctggtgatcatgttgatcgatgagctgtgtggcccagacccttccctgtcggacgagctgatctccatcctcaacgagctcactcagctgagcaaaagcgagcactgcaaagtggccctcagagcccggcagatcctgatcgcctccacctcccctcctacgagctgcggcataaccaggtggagtccattttcctgtctgccattgacatgtacggccaccagttctgccccgagaacctccagaaattaatactttcggaaacaaccatcttcgacgtcctgaatactttcttctatcacgcaaacaaagtcgtgtgcatggcgtccttggaggtttacgtggggggggcttacatcgcctatgtgttaaacagcctgcagcaccggcagctcccggacggcacctgcgtggtagaattccagttcatgctgccgtcctcccacccaaaccggatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaactcaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaatcaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccatcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaataaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgtaagtaagcatctcatatatttcagccaaataaatgggccaagggaaaaaaatatatatatatagacaggactagagaaaacctatttttgtaatgatgtttctttggatactgtctagtcacccagaaaaatgtatggatgaatttttttttttttttttgagacaaagtctcactgtgtcatgcaggctggagtgcagtggcatgatctcactgcaacctccatctcctgtctcagcctcctagataactgggattacaggtgcccaccaccatgcccggctaatttttgtatttttggtagagacagagtttcaccaggttggtcaggctggtctcaaactcttgacttcaggtaatccacccaccttggcctcccaaagtgctgggattacaggcatgagccaccatcttcagccagatgatttttttattgagagagtgaaatgctattttgttccccaaatggctgctttgggaactgaaggtttttctgttgggaaggccctcttggttttggagagaaagacaagttatgagtagctgctaccctggaacggtgggcagagagcctactaggaaatgtgcagaataaactattttttgaaggaaaactttggcct

SEQ ID NO: 345223 - DNA, 5142 bp, Homo sapiens
agcggagacaatgccacccaagccattgggaagagtcatgagataaggcacatgtagcattttagacagtgcctggcacaaaggaagttgttgactgatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaactcaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcatgtttcactccttcggcaatcaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccatcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaataaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgtaagtaagcatctcatatatttcagccaaataaatgggccaagggaaaaaaatatatatatatagacaggactagagaaaacctatttttgtaatgatgtttctttggatactgtctagtcacccagaaaaatgtatggatgaatttttttttttttttttgagacaaagtctcactgtgtcatgcaggctggagtgcagtggcatgatctcactgcaacctccatctcctgtctcagcctcctagataactgggattacaggtgcccaccaccatgcccggctaatttttgtatttttggtagagacagagtttcaccaggttggtcaggctggtctcaaactcttgacttcaggtaatccacccaccttggcctcccaaagtgctgggattacaggcatgagccaccatcttcagccagatgatttttttattgagagagtgaaatgctattttgttccccaaatggcgctagtgaatcactaggagggtcccactgataggccatgtttagcactggttgccagggattctctttttgagagagggaaagcaaaatgaatggaagtacccagctggaggtttcagggcttctggaggatgctctcgcatagctcgaggtcctctgcccacctcttctctccaaggaaaatgaggactgccccttccccctgcaggattggcccccagcctgcgcatgcaccctcctcttgcccaagtggggagcacagaggcggagaggaatcccttaccacacccacggcccagcttgctcacgagtgtcacctctgtgacggtcaccactgctcccttggagggccacttgagttactgttgcttcctcgcctgctggcttgatgagcaccgatggtgggatctgaccccgaggggcagagctgtcggtgactgaggactggactgtggtgaccatgccgatttgctcagggagaacgttgcaatgcacccagcagctcctggctctgcaggcggcacagcctggggccctgtgatcctctggtttcttccattggggcggagtcgggggtggagggagctggccacaacccactgctctgatgggtggtttgtccaaggatgctgaatgtaatgcctggtcaatgtggaagcccatgaggttgcccagggaagcctccaaaagctgggatgcttgagggtatccaagttgaaaaagacaaaatctgaccatcagccagtgacagtcctggcaaatgaaggtggggcggggcagtgaggggtgggagaaggtgaatgattcattattccaccccgaggtttgctggggtgaggggaagaatcgatgctgctttgggaactgaaggtttttctgttgggaaggccctcttggttttggagagaaagacaagttatgagtagctgctaccctggaacggtgggcagagagcctactaggaaatgtgcagaataaactattttttgaaggaaaactttggcct

SEQ ID NO: 345224 - DNA, 2629 bp, Homo sapiens
ttggacccccctgcgacagagtgtgcatagaaagtatgcagacaaagagagcgggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaataaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgtaagtaagcatctcatatatttcagccaaataaatgggccaagggaaaaaaatatatatatatagacaggactagagaaaacctatttttgtaatgatgtttctttggatactgtctagtcacccagaaaaatgtatggatgaatttttttttttttttttgagacaaagtctcactgtgtcatgcaggctggagtgcagtggcatgatctcactgcaacctccatctcctgtctcagcctcctagataactgggattacaggtgcccaccaccatgcccggctaatttttgtatttttggtagagacagagtttcaccaggttggtcaggctggtctcaaactcttgacttcaggtaatccacccaccttggcctcccaaagtgctgggattacaggcatgagccaccatcttcagccagatgatttttttattgagagagtgaaatgctattttgttccccaaatggcgctagtgaatcactaggagggtcccactgataggccatgtttagcactggttgccagggattctctttttgagagagggaaagcaaaatgaatggaagtacccagctggaggtttcagggcttctggaggatgctctcgcatagctcgaggtcctctgcccacctcttctctccaaggaaaatgaggactgccccttccccctgcaggattggcccccagcctgcgcatgcaccctcctcttgcccaagtggggagcacagaggcggagaggaatcccttaccacacccacggcccagcttgctcacgagtgtcacctctgtgacggtcaccactgctcccttggagggccacttgagttactgttgcttcctcgcctgctggcttgatgagcaccgatggtgggatctgaccccgaggggcagagctgtcggtgactgaggactggactgtggtgaccatgccgatttgctcagggagaacgttgcaatgcacccagcagctcctggctctgcaggcggcacagcctggggccctgtgatcctctggtttcttccattggggcggagtcgggggtggagggagctggccacaacccactgctctgatgggtggtttgtccaaggatgctgaatgtaatgcctggtcaatgtggaagcccatgaggttgcccagggaagcctccaaaagctgggatgcttgagggtatccaagttgaaaaagacaaaatctgaccatcagccagtgacagtcctggcaaatgaaggtggggcggggcagtgaggggtgggagaaggtgaatgattcattattccaccccgaggtttgctggggtgaggggaagaatcgatgctgctttgggaactgaaggtttttctgttgggaaggccctcttggttttggagagaaagacaagttatgagtagctgctaccctggaacggtgggcagagagcctactaggaaatgtgcagaataaactattttttgaaggaaaactttggcct

SEQ ID NO: 345225 - DNA, 2434 bp, Homo sapiens
agcggagacaatgccacccaagccattgggaagagtcatgagataaggcacatgtagcattttagacagtgcctggcacaaaggaagttgttgactgatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaactcaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaatcaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtgaccaaaaaggggcctgtgcagagtggatccttgggggccaggagtcattttaacattcccattggtctctggtgggggatttttctcaatatgaagccagtttcattcctactgatacaagagctctttttttccaatttgcagctatctgggtccttatgagaaaaaaaaaattagttttaggcaattctggtcgatctaactccctgtattactgacattttaaaacaaattattgaagtgccattacacattgcagaaaattagaaaaggaaccccccaaaaaagtaattttgcagcttctatcattctggtatagttccctctcatcttctgtctttatgtggttaatttatagtgaatatgcagttttgtattctacttttttcactgtattaaaacattttccttgttgaaaagtctctatacttaat

SEQ ID NO: 345226 - DNA, 1275 bp, Homo sapiens
ctttgacttcctgggctcaagtgatcctcccgtctcagcctcctgactagctgggactacaggcacgtgccaccacagccggctaatttttgtatttttggtagagacagagtttcaccaggttggtcaggctggtctcaaactcttgacttcaggtaatccacccaccttggcctcccaaagtgctgggattacaggcatgagccaccatcttcagccagatgatttttttattgagagagtgaaatgctattttgttccccaaatggcgctagtgaatcactaggagggtcccactgataggccatgtttagcactggttgccagggattctctttttgagagagggaaagcaaaatgaatggaagtacccagctggaggtttcagggcttctggaggatgctctcgcatagctcgaggtcctctgcccacctcttctctccaaggaaaatgaggactgccccttccccctgcaggattggcccccagcctgcgcatgcaccctcctcttgcccaagtggggagcacagaggcggagaggaatcccttaccacacccacggcccagcttgctcacgagtgtcacctctgtgacggtcaccactgctcccttggagggccacttgagttactgttgcttcctcgcctgctggcttgatgagcaccgatggtgggatctgaccccgaggggcagagctgtcggtgactgaggactggactgtggtgaccatgccgatttgctcagggagaacgttgcaatgcacccagcagctcctggctctgcaggcggcacagcctggggccctgtgatcctctggtttcttccattggggcggagtcgggggtggagggagctggccacaacccactgctctgatgggtggtttgtccaaggatgctgaatgtaatgcctggtcaatgtggaagcccatgaggttgcccagggaagcctccaaaagctgggatgcttgagggtatccaagttgaaaaagacaaaatctgaccatcagccagtgacagtcctggcaaatgaaggtggggcggggcagtgaggggtgggagaaggtgaatgattcattattccaccccgaggtttgctggggtgaggggaagaatcgatgctgctttgggaactgaaggtttttctgttgggaaggccctcttggttttggagagaaagacaagttatgagtagctgctaccctggaacggtgggcagagagcctactaggaaatgtgcagaataaactattttttgaaggaaaactttggcct

SEQ ID NO: 345227 - DNA, 2029 bp, Homo sapiens
agcggagacaatgccacccaagccattgggaagagtcatgagataaggcacatgtagcattttagacagtgcctggcacaaaggaagttgttgactgatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaactcaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaatcaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaagtacgtcgtgaaactggcggggcagggtgattctgctcagctactactgtattttcagtgggagtgctagcacctgcaagaggtgaaaaaaatctcacttatgtataaagcacagatgtacatgtagtgtataaacaggcatacagtgtatcagtgatactaacatttcactgtggcgggggggatggtgatgagaaaaaaaagatctaaaaaggctccttaacggggataatgaaaaaagtctataaaccctgagctgatatacactgagcgctcctgaatgcagtgtgcactgagaatgcagaggtgattgtgtcaactccctggcctcatagcgttcttagaattatggctcacacctg

SEQ ID NO: 345228 - DNA, 371 bp, Homo sapiens
atcagaaacagtgcccctcctctaggagggcagaaattagcaaagttagagaggactgtggctggagagcaggagggttatgctgccatggaaaaagtcgtacactcttagacctgaaaggggccctccagagttcagaaagcattattttaaacagttggctcagtctttccatctgtgggtaaagatacagaggcccagagagggaaagtgacttgtctaagggcacacagcatgtgtgggggtaaaagagctgaggactgacacccagatcttctggctctcttccctccagctccccccacatccattagcccttgcttgctgggcaatgcctcatatacccccatccctgcctcttctcttttaag

SEQ ID NO: 345229 - DNA, 552 bp, Homo sapiens
acattaagaaaaaaaaaacagtggctttcagtgcagggaactggattcgtagcctcactaaagtattttttaagggatttaaatacctgtacctgactccccaagactacaccagaatcagctccctgaactccgtccactgtaaacacatcgaggaaggaggagagtccaggtaaataacttatcaggtagctccttaattttgctcatggttaatttcagctgtcttctttcctcggggcttgtggcgatattttccagtggggtggtggtgtttgtatgatgggaaccaatgcctgttgggggcactgatgccttaaacatttgttaaactctccaaggtgagtccatccttgtcattctaaaatgagtgactcctttcacaaaaaatagcacgtcatgtagggagaatgagattggattctcgtgaatctcctaggagccgcaggctcacattttgtgaccaaactgatgcagcggtgacttggcaaactgggaaggtatgggtggggcagagagaggtctgttcttcgagagcattcaaaggctact

SEQ ID NO: 345230 - DNA, 541 bp, Homo sapiens
gcccaggccatcaaggacttcaaccgggagaagttgcccctgatgatctttgccaactggagggggttctccggtggcatgaaaggtaagcccctccctgcctatgttaccccaaagccttggggtcagcacccaggacagcaccctctgggtggtgatgctaatgtcctagtctgtgcccatcatcatcttagctgtgtctcccaacaaccctgaggagaaaatattgttcaggtgccccactaccccgttttaaagatgaggaactgctgggcacagtggcagacacctgtaatcccggtgctttgggaggccaaggcagaaagatcatttgaggccaggagtttgagaccagcctggggcagtatagcaagaccctgtctctacaaaaaaacaaaataaatgtttaaaaaattagctgggcatggtggcacatgcctattgtcccagctatttgggaggctgaggtgggaggattgcttgagcccaggaggttgaggctgtactccagcctgggcaacggagtgagacccccatctca

SEQ ID NO: 345231 - DNA, 7367 bp, Homo sapiens
actcagtattaatggtagcatacatcaccagtctatgagtgtcttgtgtgccatcatttaaaactcaatctatgatgtggtatgcttgcatggctgcgacgcagatacccccctccccacctgatgcaaaattttgaagaacttaaatatccgcgtgcctagcctcatcgctaaggatactgatgcagtaagtctgggacaagggcctggtttgggaactacactgcttctcctggggagagaaccggaaagaggccatttcgaacatggtggtggctttgaaggaactgtccatccgaggcgactttaggactaccgtggaatacctcattaacctcctggagaccgagagcttccagaacaacgacatcgacaccgggtggttggactacctcattgctgagaaagtgcaaaagaaaccgaatatcatgcttggggtggtatgcggggcccttgaacgtggagatgcgatgttcagaacgtgcatgacagatttcttacactccctggaaaggggccaggtcctcccagcggattcactactgaacctcgtagatgtggaattaatttacgagggtgtaaagtacattctaaaggtgacccggcagtctctgaccatgttcgttctcatcatgaatggctgccacatcgagattgatgcccaccggctgaatgatggggggctcctgctctcctacaatgggaacagctacaccacctacatgaaggaagaggttgacagttaccgaattaccatcggcaataagacgtgtgtttttgagaaggagaacgatcctacagtcctgagatccccctcggctgggaagctgacacagtatcacagtggaggatgggggccacgttgaggctgggagcacgctacgctgagatggaggtgatgaagatgatcatgaccctgaacgttcaggaaagaggccgggtgaagtacatcaagcgtccaggtgcggtgctggaagcaggctgcgtggtggccaggctggagctcgatgacccttctaaagtccacccggctgaaccgttcacaggagaactccctgcccagcagaacactgccgatcctcggaaagaaactgcaccagggtcttccacagcgtcctgggaagcctcaccaacgtcatgagtggcttttgtctgccagagccgttttttagcataaagctgaaggagtgggtgcagaagctcatgatgaccctccggcacccgtcactgctgctggacgtgcaggagatcatgaccagtcgtgcaggccgcatccccccccctgttgagaagtctgtccgcaaggtgatggcccagtatgccagcaacatcacctcggtgctgtgccagttccccagccagcagatagccaccatcctggactgccatgcagccaccctgcagcggaaggctgatcgagaggtcttcttcatcaacacccagagcatggtgcagttggtccagaggtaccgaagtggaatccgcggctcatatgaaaacagtggtgatcgatctcttgagaagatacttgcgtgttgagcaccattttcggcaagcccactacgacaagtgtgtgataaacctcagggaacagttcaagccagacatgtcccaggtgctggactgcatcttctcccacgcacaggtggccaagaagaaccagctggtgatcatgttgatcgatgagctgtgtggcccagacccttccctgtcggacgagctgatctccatcctcaacgagctcactcagctgagcaaaagcgagcactgcaaagtggccctcagagcccggcagatcctgatcgcctccacctcccctcctacgagctgcggcataaccaggtggagtccattttcctgtctgccattgacatgtacggccaccagttctgccccgagaacctccagaaattaatactttcggaaacaaccatcttcgacgtcctgaatactttcttctatcacgcaaacaaagtcgtgtgcatggcgtccttggaggtttacgtggggggggcttacatcgcctatgtgttaaacagcctgcagcaccggcagctcccggacggcacctgcgtggtagaattccagttcatgctgccgtcctcccacccaaaccggatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaactcaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaatcaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccatcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaataaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgtaagtaagcatctcatatatttcagccaaataaatgggccaagggaaaaaaatatatatatatagacaggactagagaaaacctatttttgtaatgatgtttctttggatactgtctagtcacccagaaaaatgtatggatgaatttttttttttttttttgagacaaagtctcactgtgtcatgcaggctggagtgcagtggcatgatctcactgcaacctccatctcctgtctcagcctcctagataactgggattacaggtgcccaccaccatgcccggctaatttttgtatttttggtagagacagagtttcaccaggttggtcaggctggtctcaaactcttgacttcaggtaatccacccaccttggcctcccaaagtgctgggattacaggcatgagccaccatcttcagccagatgatttttttattgagagagtgaaatgctattttgttccccaaatggcgctagtgaatcactaggagggtcccactgataggccatgtttagcactggttgccagggattctctttttgagagagggaaagcaaaatgaatggaagtacccagctggaggtttcagggcttctggaggatgctctcgcatagctcgaggtcctctgcccacctcttctctccaaggaaaatgaggactgccccttccccctgcaggattggcccccagcctgcgcatgcaccctcctcttgcccaagtggggagcacagaggcggagaggaatcccttaccacacccacggcccagcttgctcacgagtgtcacctctgtgacggtcaccactgctcccttggagggccacttgagttactgttgcttcctcgcctgctggcttgatgagcaccgatggtgggatctgaccccgaggggcagagctgtcggtgactgaggactggactgtggtgaccatgccgatttgctcagggagaacgttgcaatgcacccagcagctcctggctctgcaggcggcacagcctggggccctgtgatcctctggtttcttccattggggcggagtcgggggtggagggagctggccacaacccactgctctgatgggtggtttgtccaaggatgctgaatgtaatgcctggtcaatgtggaagcccatgaggttgcccagggaagcctccaaaagctgggatgcttgagggtatccaagttgaaaaagacaaaatctgaccatcagccagtgacagtcctggcaaatgaaggtggggcggggcagtgaggggtgggagaaggtgaatgattcattattccaccccgaggtttgctggggtgaggggaagaatcgatgctgctttgggaactgaaggtttttctgttgggaaggccctcttggttttggagagaaagacaagttatgagtagctgctaccctggaacggtgggcagagagcctactaggaaatgtgcagaataaactattttttgaaggaaaactttggcct

SEQ ID NO: 345232 - DNA, 7240 bp, Homo sapiens
tgctgggattacaggcgtgagccaccacacccggccactcctgtgcttttccagttctctgaatcacatcattgcagcaactctgttgatgtatgcatgaatttggaaaatgatccatgtgcctttcccttcaaggaacatggtggtggctttgaaggaactgtccatccgaggcgactttaggactaccgtggaatacctcattaacctcctggagaccgagagcttccagaacaacgacatcgacaccgggtggttggactacctcattgctgagaaagtgcaaaagaaaccgaatatcatgcttggggtggtatgcggggcccttgaacgtggagatgcgatgttcagaacgtgcatgacagatttcttacactccctggaaaggggccaggtcctcccagcggattcactactgaacctcgtagatgtggaattaatttacgagggtgtaaagtacattctaaaggtgacccggcagtctctgaccatgttcgttctcatcatgaatggctgccacatcgagattgatgcccaccggctgaatgatggggggctcctgctctcctacaatgggaacagctacaccacctacatgaaggaagaggttgacagttaccgaattaccatcggcaataagacgtgtgtttttgagaaggagaacgatcctacagtcctgagatccccctcggctgggaagctgacacagtatcacagtggaggatgggggccacgttgaggctgggagcacgctacgctgagatggaggtgatgaagatgatcatgaccctgaacgttcaggaaagaggccgggtgaagtacatcaagcgtccaggtgcggtgctggaagcaggctgcgtggtggccaggctggagctcgatgacccttctaaagtccacccggctgaaccgttcacaggagaactccctgcccagcagaacactgccgatcctcggaaagaaactgcaccagggtcttccacagcgtcctgggaagcctcaccaacgtcatgagtggcttttgtctgccagagccgttttttagcataaagctgaaggagtgggtgcagaagctcatgatgaccctccggcacccgtcactgctgctggacgtgcaggagatcatgaccagtcgtgcaggccgcatccccccccctgttgagaagtctgtccgcaaggtgatggcccagtatgccagcaacatcacctcggtgctgtgccagttccccagccagcagatagccaccatcctggactgccatgcagccaccctgcagcggaaggctgatcgagaggtcttcttcatcaacacccagagcatggtgcagttggtccagaggtaccgaagtggaatccgcggctcatatgaaaacagtggtgatcgatctcttgagaagatacttgcgtgttgagcaccattttcggcaagcccactacgacaagtgtgtgataaacctcagggaacagttcaagccagacatgtcccaggtgctggactgcatcttctcccacgcacaggtggccaagaagaaccagctggtgatcatgttgatcgatgagctgtgtggcccagacccttccctgtcggacgagctgatctccatcctcaacgagctcactcagctgagcaaaagcgagcactgcaaagtggccctcagagcccggcagatcctgatcgcctccacctcccctcctacgagctgcggcataaccaggtggagtccattttcctgtctgccattgacatgtacggccaccagttctgccccgagaacctccagaaattaatactttcggaaacaaccatcttcgacgtcctgaatactttcttctatcacgcaaacaaagtcgtgtgcatggcgtccttggaggtttacgtggggggggcttacatcgcctatgtgttaaacagcctgcagcaccggcagctcccggacggcacctgcgtggtagaattccagttcatgctgccgtcctcccacccaaaccggatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaactcaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaatcaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccatcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaataaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgtaagtaagcatctcatatatttcagccaaataaatgggccaagggaaaaaaatatatatatatagacaggactagagaaaacctatttttgtaatgatgtttctttggatactgtctagtcacccagaaaaatgtatggatgaatttttttttttttttttgagacaaagtctcactgtgtcatgcaggctggagtgcagtggcatgatctcactgcaacctccatctcctgtctcagcctcctagataactgggattacaggtgcccaccaccatgcccggctaatttttgtatttttggtagagacagagtttcaccaggttggtcaggctggtctcaaactcttgacttcaggtaatccacccaccttggcctcccaaagtgctgggattacaggcatgagccaccatcttcagccagatgatttttttattgagagagtgaaatgctattttgttccccaaatggcgctagtgaatcactaggagggtcccactgataggccatgtttagcactggttgccagggattctctttttgagagagggaaagcaaaatgaatggaagtacccagctggaggtttcagggcttctggaggatgctctcgcatagctcgaggtcctctgcccacctcttctctccaaggaaaatgaggactgccccttccccctgcaggattggcccccagcctgcgcatgcaccctcctcttgcccaagtggggagcacagaggcggagaggaatcccttaccacacccacggcccagcttgctcacgagtgtcacctctgtgacggtcaccactgctcccttggagggccacttgagttactgttgcttcctcgcctgctggcttgatgagcaccgatggtgggatctgaccccgaggggcagagctgtcggtgactgaggactggactgtggtgaccatgccgatttgctcagggagaacgttgcaatgcacccagcagctcctggctctgcaggcggcacagcctggggccctgtgatcctctggtttcttccattggggcggagtcgggggtggagggagctggccacaacccactgctctgatgggtggtttgtccaaggatgctgaatgtaatgcctggtcaatgtggaagcccatgaggttgcccagggaagcctccaaaagctgggatgcttgagggtatccaagttgaaaaagacaaaatctgaccatcagccagtgacagtcctggcaaatgaaggtggggcggggcagtgaggggtgggagaaggtgaatgattcattattccaccccgaggtttgctggggtgaggggaagaatcgatgctgctttgggaactgaaggtttttctgttgggaaggccctcttggttttggagagaaagacaagttatgagtagctgctaccctggaacggtgggcagagagcctactaggaaatgtgcagaataaactattttttgaaggaaaactttggcct

SEQ ID NO: 345233 - DNA, 5346 bp, Homo sapiens
agcggagacaatgccacccaagccattgggaagagtcatgagataaggcacatgtagcattttagacagtgcctggcacaaaggaagttgttgactgatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaactcaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaatcaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccatcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaataaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgtaagtaagcatctcatatatttcagccaaataaatgggccaagggaaaaaaatatatatatatagacaggactagagaaaacctatttttgtaatgatgtttctttggatactgtctagtcacccagaaaaatgtatggatgaatttttttttttttttttgagacaaagtctcactgtgtcatgcaggctggagtgcagtggcatgatctcactgcaacctccatctcctgtctcagcctcctagataactgggattacaggtgcccaccaccatgcccggctaatttttgtatttttggtagagacagagtttcaccaggttggtcaggctggtctcaaactcttgacttcaggtaatccacccaccttggcctcccaaagtgctgggattacaggcatgagccaccatcttcagccagatgatttttttattgagagagtgaaatgctattttgttccccaaatggcgctagtgaatcactaggagggtcccactgataggccatgtttagcactggttgccagggattctctttttgagagagggaaagcaaaatgaatggaagtacccagctggaggtttcagggcttctggaggatgctctcgcatagctcgaggtcctctgcccacctcttctctccaaggaaaatgaggactgccccttccccctgcaggattggcccccagcctgcgcatgcaccctcctcttgcccaagtggggagcacagaggcggagaggaatcccttaccacacccacggcccagcttgctcacgagtgtcacctctgtgacggtcaccactgctcccttggagggccacttgagttactgttgcttcctcgcctgctggcttgatgagcaccgatggtgggatctgaccccgaggggcagagctgtcggtgactgaggactggactgtggtgaccatgccgatttgctcagggagaacgttgcaatgcacccagcagctcctggctctgcaggcggcacagcctggggccctgtgatcctctggtttcttccattggggcggagtcgggggtggagggagctggccacaacccactgctctgatgggtggtttgtccaaggatgctgaatgtaatgcctggtcaatgtggaagcccatgaggttgcccagggaagcctccaaaagctgggatgcttgagggtatccaagttgaaaaagacaaaatctgaccatcagccagtgacagtcctggcaaatgaaggtggggcggggcagtgaggggtgggagaaggtgaatgattcattattccaccccgaggtttgctggggtgaggggaagaatcgatgctgctttgggaactgaaggtttttctgttgggaaggccctcttggttttggagagaaagacaagttatgagtagctgctaccctggaacggtgggcagagagcctactaggaaatgtgcagaataaactattttttgaaggaaaactttggcct

SEQ ID NO: 345234 - DNA, 1357 bp, Homo sapiens
agcggagacaatgccacccaagccattgggaagagtcatgagataaggcacatgtagcattttagacagtgcctggcacaaaggaagttgttgactgatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaactcaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaatcaagcaagggccccagcacgggatgctgatcaatactccctacgtcaccaaggatctgctccaggccaagcgattccaggcccagaccctgggaaccacctacatctatgacttcccggaaatgttcaggcaggcaagtccggcggctcagacgcggtaccccctgggtcctcccagcagactccaccagaaccaaagcccatccttaattctcct

SEQ ID NO: 345235 - DNA, 433 bp, Homo sapiens
aagccactgcagctttgaagaatgtggctcatgagaggactcatagttcattacgtaacattcagcagagcggaaaatataagcactgtctccatcacttgacttgctttccattttgatttagttatctggtaaagtctaggtatcctatagtggaagaatgaaagacaagcaggttccaatgaaggaccatgcttccaaaggcatcagccagtggatcgtttgtggggccaggcgggggttagatctattattgttggacaggggtattagagttttgaaagactacttgaaaaacataatcaaatgatacttggagtttgttccgaaagggtattctttcctctctcttcccacaacagtgtgcgcttcctattatagttgatatacctgtgctttaaaatagcacagctactagtagaggccattttat

SEQ ID NO: 345236 - DNA, 742 bp, Homo sapiens
ttaaattggaagtatgattttagagaaaaaaaagaatcatgtaaaatttctgactaaaggagagtacggtttgtatatttttaaatggatgatggtaggtttcaaatgatgatggtatttgtattccattgaatatatttaaaagaagaatgaaataatttcatgttaaaatgctagacttttaataaaattatatattaaaatatatacttaaacttacgatgatatatataaacttatgatatatattatatatatttaaacttatgataaacatttagatgccgactgtaaaatggaggtacacagggttgacattatttcatttaggttgcatataagcaaaaatgtttgaagaccacaagtataatccacctttatttcctgacttctgaaattatcaccctatcactaccataattaacctctaccttcttagatccaaaggacattcagacatcaccttaattgacctctcttcagcatttgatacttcttccttttttaaacaagcttaacttgacttaacaccgcctatcctactttcctctttctactacactttcaccgtcatgcatgcttgctacaggaatacattctcagaaatgcatcattaggcgatttcatcattctgtggacatgatagagcgtaattcacaaacctaggttgggtagcccactacacacctaagctgtatggtgtaacttattgcttgtaggctacaaacctgtacagtacatt

SEQ ID NO: 345237 - DNA, 503 bp, Homo sapiens
aaattgttacaaagttcagctggaagtttccttccctgtgtggtttcttcccggttcctctggcagccctccccaaggacttctgtaagacaaagtcggaagttacttccttggggaccgagagcccacaggggtcttcctactgcttcttctacccctgtatttcactcagctctctaaatttgtctcagctccaggaaggcagggatttcaacctgggcaacaagtccacagaacatgagatttctgaaggtgtgtgggatacatcatggttacataaaaatcctttcactatagttcctgcttccctatcttcaaaatgattccctgaagacttccgccatgacggtctaaagcctaacctctgaactgtggatggaaaattgaactccttgatgtgatctctgcacatcatgcaaccctaaacctaaatatattctctgtgtgggagccccattatttttagtctaatacattttaagtcatcttaaaaaattatattt

SEQ ID NO: 345238 - DNA, 1027 bp, Homo sapiens
agcggagtagctattctcttctccctgaagggaggcaacactgtccgttcgcctgactggcagtgttttaaggacccatcgcgcttgacgggaaagtcaggtacaagctgatgctgttatcaccacaggaaccaggggctgagcggtgaaatccagctcctcccagctggaagacactagggtgaacggagataaaagcagttctctttacccgaagtttatttctttttcatgccacttcaaatttggattaaaaatcaagaaatataaaccagatgtagcagtttcttgacatggagaaccaagcccataatacgatgggaacttctccttgtgaggctgagcttcaggaattaatggaacaaattgacatcatggtaagcaacaagaaaatggattgggaaagaaagatgcgggctttggagacacgattagatcttcgggatcaagaattggcaaatgcacaaacttgtttggatcagaaaggtcaagaggtagggttacttcgacagaaattggacagtctggaaaaatgtaatttagcaatgactcagaattatgaaggacaactacaaagcctaaaggctcaagtaagaaaacttattataatttaatatcacacattttgatatatttttttttacctgtagagttgtgttaactttaaactgttttcagtataaacaaatgtcttgtattttaattataagcttggtcatgtctttccctgttttatatgcattgattttgtctcttactagattgttgtcttgctatattttctgtgcctctgttagcacagtagtagacaaatggctttctatttctcaagagacttgttgatgaattaaataataattagctcacaaaaaataattctgtgagcaacaacaaaaaacaattattttttgtggttattactatctaataaagatgttctcaattctgtgataatttaaaatgtggaagtttgctgttatgaaatagataattgaaataataaaactggtctttattaccttgttac

SEQ ID NO: 345239 - DNA, 526 bp, Homo sapiens
agcggagtagctattctcttctccctgaagggaggcaacactgtccgttcgcctgactggcagtgttttaaggacccatcgcgcttgacgggaaagtcaggtacaagctgatgctgttatcaccacaggaaccaggggctgagcggtgaaatccagctcctcccagctggaagacactagggtgaacggagataaaagcagttctctttacccgaagtttatttctttttcatgccacttcaaatttggattaaaaatcaagaaatataaaccagatgtagcagtttcttgacatggagaaccaagcccataatacgatggggctgaagtgtaagacctcaataactacctgcttatccagtctgagtgactggacttacaccagctcccgggagaatgcttcagcttctttgaaaaagaactctgtagtgagagcacttaccaatctgtcttaacaacagttgctatagtcctagctgttatactaagcattttgtttgaaactcaataaaccctcctggaccca

SEQ ID NO: 345240 - DNA, 838 bp, Homo sapiens
agcggagtagctattctcttctccctgaagggaggcaacactgtccgttcgcctgactggcagtgttttaaggacccatcgcgcttgacgggaaagtcaggtacaagctgatgctgttatcaccacaggaaccaggggctgagcggtgaaatccagctcctcccagctggaagacactagggtgaacggagataaaagcagttctctttacccgaagtttatttctttttcatgccacttcaaatttggattaaaaatcaagaaatataaaccagatgtagcagtttcttgacatggagaaccaagcccataatacgatgggaacttctccttgtgaggctgagcttcaggaattaatggaacaaattgacatcatggtaagcaacaagaaaatggattgggaaagaaagatgcgggctttggagacacgattagatcttcgggatcaagaattggcaaatgcacaaacttgtttggatcagaaaggtcaagaggtagggttacttcgacagaaattggacagtctggaaaaatgtaatttagcaatgactcagaattatgaaggacaactacaaagcctaaaggctcaattttccaaactaacaaataactttgaaaaactgagattacatcagatgaaacaaaacaaagttccacgaaaagaattaccacaccttaaagaagaaataccctttgaactgagcaatttgaaccagaaattagaggaatttagagcaaagtcaagagaatgggacaagcaagagatattatatcagactcatctgatttctttagatgctcaacaaaaattattatctgagaagtgtaatcagtttca

SEQ ID NO: 345241 - DNA, 130 bp, Homo sapiens
aaaaaaagaaaaaaagtaaatctagatatagaccttacacctttgacaaaaattatcttgaaatgcatcataaatgcaaaatgcaaaactataaactgtctaaaaggtaacataggagaaaacctagatg

SEQ ID NO: 345242 - DNA, 237 bp, Homo sapiens
actcacaaacatatatatgcacaaacatacatacacatacatgctatgaaataatctatagctaagtgaaacatgagacatctcagcatgtgaaactgtaataatctcattcagttaccttttgctaaagtagactttattcttttgcatttctattatttctttcttattacttttctttgtttattctaactttcttgttgtctgccttgctttaatcattttgtttcttctctt

SEQ ID NO: 345243 - DNA, 545 bp, Homo sapiens
atgagtgagcctgtgctgtcgtgagggcagcttgaggatggtaggatggtaggatggtagtgtgctggtaaacagtgggcactccagggaggaaaaggcctgaactgtaacatttaccagtttccatggtaaaattctctcttcatggccaatttcaagctaccagtgtgactactactgagtgcggagttgggaaaacatgggcagtctcaccattgtatagtatttctaccatacatcagcaatagactttaataacttcaaatgcatagatagaggaaaataagtaggctgggcacagtggctcacgactgtaatcccactactcgggaggctgaggcaggagaaacgcttgaacccgggaggcggaggttgcagtgagaagtaggaagagataaatgatgagcatttattgcttttgttttaatgtaatttctttgttgtcaatgatttggtttttaataatggccatgtttgacaactggctcacaaaattcctgaaagttctatcagctctcgcaagctggactaagcctgttctggca

SEQ ID NO: 345244 - DNA, 669 bp, Homo sapiens
tgcggttctcagtttggagtttggtcaaacaaccaatggggacagagtcttggggtcaggtccagcaggaactgccacccctcccagggacagcctgtctctcccactcaccatcgctggtgcccacgggctgctgaccacctgccaagtcctcctgtccctggaccagcctctcaggcagcaggtcttacctttgcctccagggcactgatcgatggcagctttgtctcactgtaaggcaacccagacagagctgagggcctgtgctgggccgggagctgtcctcctccttccctagcagtcctagggaaggaccagccgtgtctctccccaccccacccctggtcttagcccaggagacacacagggaaggtaggaagagggtctccctgtgggctgacgcctgtgaagggacaggacctgggagaagaggggtgtgtgggtggggcagggaccactagggccctgtagagcatgggcttgggctacacaacagggctgcccctcctgggctagaggcagtgccctctgcaggagctgagaatgtccagtcctgagaaaggacgtgtatggcccagggtgggtgactgggcccccccagtgcactgagggtgcacctggggcctgtcccacctgatgtccccaagtgccccgcaaggtctgatctct

SEQ ID NO: 345245 - DNA, 723 bp, Homo sapiens
tgcggttctcagtttggagtttggtcaaacaaccaatggggacagagtcttggggtcaggtccagcaggaactgccacccctcccagggacagcctgtctctcccactcaccatcgctggtgcccacgggctgctgaccacctgccaagtcctcctgtccctggaccagcctctcaggcagcaggtcttacctttgcctccagggcactgatcgatggcagctttgtctcactgtaaggcaacccagacagagctgagggcctgtgctgggccgggagctgtcctcctccttccctagcagtcctagggaaggaccagccgtgtctctccccaccccacccctggtcttagcccaggagacacacagggaaggtaggaagagggtctccctgtgggctgacgcctgtgaagggacaggacctgggagaagaggggtgtgtgggtggggcagggaccactagggccctgtagagcatgggcttgggctacacaacagggctgcccctcctgggctagaggcagtgccctctgcaggagctgagaatgtccagtcctgagaaaggacgtgtatggcccagggtgggtgactgggccccaaaagcagtcctcgagggagtgaccacattaccaggccaggatcctgagacctgcccagtgcactgagggtgcacctggggcctgtcccacctgatgtccccaagtgccccgcaaggtctgatctct

SEQ ID NO: 345246 - DNA, 703 bp, Homo sapiens
tatacttagcaaagtaatacaggaacagaaaaccaaatacatgttctcagttataggtgggagctaaatgatgaggatgcatggacatatggacataaagaagagaacagcaaatactggggctacttgaggttggagggtgggaggagggagagaagcaaaaaaacaataataacttttgggtattagacttagtacctgggtgacaaaataatctgtgcaacaaattcccatgacaggagtttacttatgtaacaaatctgcacatgtaccccgatcctaaaataaattttttttaaactgtctttatcgcattctccctgaaaggtattttaatgaatatagaattataatgtgatagtggttttctctcagcacattccaactagtattctattatcttctcacttccattaattttgttgggatgaaagctatcagaccaactgtacctcttttaaaattaatctttgcttctggctgttatttttaccagcttctcttttaattttatattttgcagtttcactggaaatttttatcctattttacatttgttgagattttcgtatttgtgttttcatcacttctggaaaacttttagctattaattattgggatttaaaaattctctctttttactacttctagatctctgatttaatatttgttaaatcacctccctctcttttctatatttcct

SEQ ID NO: 345247 - DNA, 385 bp, Homo sapiens
ccagatcagaggctacatatttctgtatttaggaaaggagatgggaattttggacgatatgcatagggtgacctcctattggtgttgctatgctgagtattttgtttcctttcagaggcacctggatagaccacttgtaaccaggcaataaacacagactccagtaaaatatggattcaagcagagccttaaaaggacaagaggggctgtgacggaatacctcaaatttcttaaaatctaggcctggaaaagatattaagtattttactgcctatcttctccaagggaaggatttcttaggtacattgaactctcacatctgtcacaattttagttaggccttgtcaacgttaaaattagtgtaattttctcctgataaacaagc

SEQ ID NO: 345248 - DNA, 446 bp, Homo sapiens
ttctctttttttcctctgccacatccagttgccaactctcaagttatgaggaaaatctaattgggccacagggtcacggctagctctcactcccttttcatcctctttgctttctcttttacttttactctaattcctgtacacatgaagtggcagccagtatgagactggtgcccagaaaataccatcctgaaggacagctgagggagggcacaagtgaagagaggcttacggaagcttagaaggaggaggaaaaagcagaagcctgagaagagaggagcagtcactaagttctccctcaacccaagacaacctgttggatcatttttctactaccaatatcaagggcaggttactagcactgcttgctgttcgtttctttgtcaaattgtggttcaggaagatgctttattaggtaaagaaatccagatcaaatacaagttgat

SEQ ID NO: 345249 - DNA, 1121 bp, Homo sapiens
tttcctgcatcttaccatccaagcaaacactggaaattgctatctttctctctgcttaataatttttaaagaccaaaaaagtgacatttacactttttagaaacacaatgactgcacggttggtgtgggtttactgcttaataacaatcattgagtcaaacagttgagagacaatggaattcaggacttggttagcctctgagagagagagagagagaatgtgtattatgtgcttgatagaaatacactgaacaacagtcattctttaaggcaaagtgctgactctaataaggccccctcttttggggcaagggagggtgagcagtcgctcaagttagtgagccctgtacattctaatcccagtttacatttaaaacacttcaaatggagccactaggactcaaagttgctaaatacacccatgccctcttatcgccttccactgggggtggttcttcggtgttttaagtcttggaagttaatttttgaggaaaaaaaagtaatagacatgtgacaaaaacaggaagaagggacacagttcagctgggttgtagctctaatctcactttatcagctgcttgaaagagggaaatgaaggacagagcggtaggaagtctgcacacaccaacctcatggagaccagctcagcccccaatgcagtcaagctacctaacctcctggaaacataaagatcggcgtgttacttggagattggagtgtatcagcttgaacacacccaccagaagctagcatgacaaccagttcagtggaaaggcagccccagcatggctcaatacctagggagtttcctgacagtacaagatcttcacccatcaccacattcagacacagctcctatggcagtttccaagataacaaagaaagtttgccttcaaattggagatactccttcatttaataaattttgttgagcaaaatttattatacgccacaagttgtccagaagctaactgcgagtgagcaagatcaggcttactctctagtggggggaaaagaggagtgagcacgcatttggaatcaactgggaaatgtgctaaaatagaggaggtgtggggtgtgttcagagcacagggagatgaagcctggaccccggccacctg

SEQ ID NO: 345250 - DNA, 424 bp, Homo sapiens
gataaactagattccctatgatctcttatttatttatcattgttttgagacagagtctcactcttgcccaggctggagtgtagtggcgcaatcttggctcaccacagcctctgcctcctgcattcaagcgattctcctggctcagcctcccgagtagctgggattacaggcgcccatcaccacacctggctaatttttgtatctttagtagagacaggctttcaccacgttggccaggctggtctcgaactcctgacctctggtgatccacccgcctaggcctccgaaaatgctgggattacaggcatgagccaccatgcccagcctgatctaaaaggaagtttttactaattgagattatgaaattttatgaaaaataaaaatgaaagaggggcacaatatctagctctgtatttaaaaatat

SEQ ID NO: 345251 - DNA, 441 bp, Homo sapiens
aaaaatattgtgaatttgcacactttccagtgttttgttgttgtcacgatgggggtgatagttcccacctttgtgtgtcctgtttggaagatgggaatctgaattcctttttatgttgggctcttaaaagaaggaactcaggttcaggatggactgttgttccctgtcacatacactcagcattttcaggagcttcatcagggaccctccagaaacttttgatccctgggaggttatgtagctggataaactgatccatgcttttacagcataaggcccacagactgcaggccttcaggactggctcttctctgacatagttggctctgctgtcccggccaccatggtcccttggattctcctaagagatgatgcaaaacttcgttcatacactgggtgttgtctttgaaggctgttgacagtgctttgctagcatggtat

SEQ ID NO: 345252 - DNA, 729 bp, Homo sapiens
catagcggggcctgagagaaggggtttggtggttgaatgagtgtggaaagcctgtattgtggcctctcctccagcccccactcaggagggactcacatggccacgctctgaggagcctgcagaaggaggcctgtctgacccagccttcctcccatgcactgatcactgttcctgtacttctgtcttaccgccccattacccatccatagatctgactctggaaacaccgatgaagtttggctgaagtcatgccagtggatggatttagtggagaggccgacccagctcaagatggaaagacagccagagatgcgctcgggcggtgggggttccttggagaaggctgaggtcagggggatgatggggtcacagcagctcagaggggaggcaagccctgaaggacagtggctacaagcgggccctgcagagatgcaaaatgagatttaagaagaggccttggatttggcatcagggtttcaagggggagcttttagggagcagtgtgtaggaggggaggggctgcagtcagtcagcagtgcactgaagggcaagtaccaggtggggaggtggaggcacccagcagcgcagcctttgtgctgactcacagtcagtgcgtcccaaaccctaggatggaggcaagcacacagggagctcttcctaggaaaaaatggggacatctcaggacatctgattatttcctttaaagagattattatgaaattactgtac

SEQ ID NO: 345253 - DNA, 642 bp, Homo sapiens
ttgcactggcgagatagaggacttgcattgcctctactcaatgcaacctattggaaggcagctaatagctaaggagggaaacactctacttttgtttgctataaattccaggagacagcatatggtggaatttttattgaagaaccaggcaaatatacatgccgttgacaatttcaaaagaacagccctcatacttgcagtacagcataacttgtcaagtatcgtcaccctcctgcttcaacaaaatatacatatctcttctcaagacatgtttggccaaactgccgaggattatgctttttgttgtgatttgagaagcatccaacaacaaattttggaacataaaaataagatgcttaaaaatcatcttcgaaatgacaatcaacgaaacagcagctatgaagcctgacacactcgacccaacccgaaccacccaagaacacaatggacaaccacaagacaccgccggtgcacaagcagaacacaacttaaaagtggcttcagaggaaaaggaccaagatggcggccgcaaactgacacctcagggacaaagagatctggacagaatcgccggacaggtggcagctgccaacaagaagcattagaacaaaccatgctgggttaataaattgcctcattcgt

SEQ ID NO: 345254 - DNA, 603 bp, Homo sapiens
gcagaaagactgctttcccaccatgcaaatattgaagcactaaacaaggagggaaacactctacttttgtttgctataaattccaggagacagcatatggtggaatttttattgaagaaccaggcaaatatacatgccgttgacaatttcaaaagaacagccctcatacttgcagtacagcataacttgtcaagtatcgtcaccctcctgcttcaacaaaatatacatatctcttctcaagacatgtttggccaaactgccgaggattatgctttttgttgtgatttgagaagcatccaacaacaaattttggaacataaaaataagatgcttaaaaatcatcttcgaaatgacaatcaaaaacagcagctatgaagcctgaaaatttgaaaaaaagaaaaaaaagaaaaaaattgaaaaaaagaaaagaaggtgcaaaagaacacaacttaaaagtggcttcagaggaaaaggaccaagatggcggccgcaaactgacacctcagggacaaagagatctggacagaatcgccggacaggtggcagctgccaacaagaagcattagaacaaaccatgctgggttaataaattgcctcattcgt

SEQ ID NO: 345255 - DNA, 434 bp, Homo sapiens
agaagcagcagccatgaagaatgaaagttttaaaacacaaggagcaagttcaaaagtctcgctctatcaccagtctggagtccagtggcatgatctcagattactgcagccttcacctcccaggttcaagcaattctcctgcctcagcctcccgaggagctgggacaacaggcacatgcgaccatgcccagaaacagcagctatgaagcctgaaaatttgaaaaaaagaaaaaaaagaaaaaaattgaaaaaaagaaaagaaggtgcaaaagaacacaacttaaaagtggcttcagaggaaaaggaccaagatggcggccgcaaactgacacctcagggacaaagagatctggacagaatcgccggacaggtggcagctgccaacaagaagcattagaacaaaccatgctgggttaataaattgcctcattcgt

SEQ ID NO: 345256 - DNA, 1210 bp, Homo sapiens
atgggaagtgctgaacgtactggggctttcaaacatgttgcctcttctgtccttcataaaaatcctatgtggtgggtagtgttagccatgtttaacaggtaaggaaactagtcagaaaggttgagtcatctttagaaggttccatgcctaataggtggcggagccaggatttgagacaaatagactgattcgaaaggcttttccatggaactgtaaggtcttctgtgaattgttaaccataaagattctctcattttgaaatttcagaagacatgaagtagaaacaatccaggaaggctttgggaagctatttgtgtgcgaggatcaaagtggtaagcaagccggccctattttagaaactggttttcctggggggttttcctcttagttttttctgttgctcgtaaatagaccttttctccaaatttcacccactggtcttttaagagctccaaggtttttccaccatgactgaagtggcagaagttctgccgtgatgagtcaggtggagatgagccgtggaaaggaggggcgtagacggtggtggcagcagtgcgtgtttatgtgtaagatgcactgcttctgtaagtcggaggccctgattactcataatgaaaacctgcatggaaatttggagtgatgtgccagcaaacttatcggtctagatctgaaaaatacactgaggagaaagtacacccggcaacaaagctcgccttatctgacagcagaagagcagagaaatcaaaagtttttgaggattcggtctacacagccaccagccacaaacagtcttgctggattatctcgtgatcgtcagcagttgtgattttccccctttttacttacattcttgatggatggagcattttatatttttaggtaattgttaaactcaaatatactgtcattaaaacacaaaaattcaatatgttaattgtctgtctgcagccagactaggaaagggtacattgttttcaaaacttaataattgaattaaaatgtaaaaaaaacaagggccttaatgtgaaggtgagggatctgcatctcctagctacccctgtctcctatctagacatctagagtctctagatcctggggtactggggagaatggacaatgttgctttcctgtgcaagatcctcagatgacatattttagcccccagggcgctcatgcctccatcttcctccagcctcatgggcatttcctc

SEQ ID NO: 345257 - DNA, 283 bp, Homo sapiens
ttagggcccttttttgtttacaaggacactgatctgcaaactgaaactaattgcccagcaagcaggcactttttctcccacaaacccagcaaaacattcactgattggttggctgggtaggactttttttttttttttgaaaaaaaatttcccctgtttctccccagtctgaagtcaggggccccagtgtttaaggttatttgaaccctttccttccaagtttaagggaattccctggcttatttttccaaaggaggtggaataaagggctggtcccattacc

SEQ ID NO: 345258 - DNA, 990 bp, Homo sapiens
  misc_feature (17)..(17): n is a, c, g, or t
  misc_feature (89)..(90): n is a, c, g, or t
  misc_feature (125)..(125): n is a, c, g, or t
  misc_feature (132)..(132): n is a, c, g, or t
  misc_feature (135)..(135): n is a, c, g, or t
  misc_feature (146)..(147): n is a, c, g, or t
agtgtaataaagggganagaaagaaggagaaatgggatgaagtgaagtggaaagatattggataaatgaaaaatatgaataaagggttnnagagattataatgaataggaataaagtgtagctgnccttccngtncgctggcctcnncccctcggacggtatcaactcagaggtcctggaagccatacgggtgacccgtcacaagaacgccatggcagagcgctgggaatcccgcatctacgccagtgaggaggatgactgagcctcgggatggggcgcccaccccctgccctgccctgaccctcgtgggaactgccaagaccatcgccaagcccccaccctaggaaatgggtcctaggtccaggatccaagaaccacagctcatctgccaacaatcccaccatgggcacatttgggactgttgggtttttcgtttccgtttctatcttcctttagaaatgtttctgcctttggggtctaaagcttttggggatgaaatgggacccctgctgattctttctgcttctaagactttgccaaatgccctgggtctaagaaagaaagagacccgctcctccactttcaggtgtaatttgcttccgctagtctgagggcagagggaccggtcaaagagggtggcacagatcgcagcaccttgaggggctgcgggtctgagggaggagacactcagctcctccctctgagaagtcccaagctgagaggggagacctgcccctttccaaccctgggaaaccatccagtctgagggaggaggccaaactcccagtgctgggggtccctgtgcagccctcaaacccttcaccttggtgcacccagccacacctggtggacacaaagctctcacatcgataggatcccatgaggatggtccccttcacctgggagaaaagtgacccagtttaggagctggaggggggtctttgtcccccacccccaaactgccctgaaataaacctggagtgagctgcc

SEQ ID NO: 345259 - DNA, 1046 bp, Homo sapiens
cacctctgaccgagttcccacctctgaccgagttccaggagctcctcccaggcatccggcatcacgggcagttactcggtgtctgagtctcccttcttcagccccatccacctacactcaaacgtggcgtggacagtggaagatccagtggacagtgctcctcccgggcagagaaagaaggagcaatggtacgctggcatcaacccctcggacggtatcaactcagaggtcctggaagccatacgggtgacccgtcacaagaacgccatggcagagcgctgggaatcccgcatctacgccagtgaggaggatgactgagcctcgggatggggcgcccaccccctgccctgccctgaccctcgtgggaactgccaagaccatcgccaagcccccaccctaggaaatgggtcctaggtccaggatccaagaaccacagctcatctgccaacaatcccaccatgggcacatttgggactgttgggtttttcgtttccgtttctatcttcctttagaaatgtttctgcctttggggtctaaagcttttggggatgaaatgggacccctgctgattctttctgcttctaagactttgccaaatgccctgggtctaagaaagaaagagacccgctcctccactttcaggtgtaatttgcttccgctagtctgagggcagagggaccggtcaaagagggtggcacagatcgcagcaccttgaggggctgcgggtctgagggaggagacactcagctcctccctctgagaagtcccaagctgagaggggagacctgcccctttccaaccctgggaaaccatccagtctgagggaggaggccaaactcccagtgctgggggtccctgtgcagccctcaaacccttcaccttggtgcacccagccacacctggtggacacaaagctctcacatcgataggatcccatgaggatggtccccttcacctgggagaaaagtgacccagtttaggagctggaggggggtctttgtcccccacccccaaactgccctgaaataaacctggagtgagctgcc

SEQ ID NO: 345260 - DNA, 1225 bp, Homo sapiens
tatctgactgcctcagctctccaatgtactgggattacagagcgtgagccagtgtgcgccagcccttctattatttatttactacgataaaatgtaatgtattatataaattatacaaagtgctgggattacaggcgcgagccatctgagctcggtcaaggcaacaaagtgagactccatctcaaaaacaaacaaaaaagccaaatacagacatttttcctgccctggagctcagcatgagttagcatattctttgatcatattactaggagtagagggtctgaaacagaggaggggatcctactttacccccgttctaggcctctctaatgaattggcagttggaggagacatcttgggggtgtggtaggacctggatcgggggaattcatgcctcctttttgcaggtcctggaagccatacgggtgacccgtcacaagaacgccatggcagagcgctgggaatcccgcatctacgccagtgaggaggatgactgagcctcgggatggggcgcccaccccctgccctgccctgaccctcgtgggaactgccaagaccatcgccaagcccccaccctaggaaatgggtcctaggtccaggatccaagaaccacagctcatctgccaacaatcccaccatgggcacatttgggactgttgggtttttcgtttccgtttctatcttcctttagaaatgtttctgcctttggggtctaaagcttttggggatgaaatgggacccctgctgattctttctgcttctaagactttgccaaatgccctgggtctaagaaagaaagagacccgctcctccactttcaggtgtaatttgcttccgctagtctgagggcagagggaccggtcaaagagggtggcacagatcgcagcaccttgaggggctgcgggtctgagggaggagacactcagctcctccctctgagaagtcccaagctgagaggggagacctgcccctttccaaccctgggaaaccatccagtctgagggaggaggccaaactcccagtgctgggggtccctgtgcagccctcaaacccttcaccttggtgcacccagccacacctggtggacacaaagctctcacatcgataggatcccatgaggatggtccccttcacctgggagaaaagtgacccagtttaggagctggaggggggtctttgtcccccacccccaaactgccctgaaataaacctggagtgagctgcc

SEQ ID NO: 345261 - DNA, 2856 bp, Homo sapiens
gtcagactgtggacgccgggagccggcagtaagcccagaggtctccaccccacgggaggaaggctgaggccaagaccccggaagagatggaccgcgtgaccagataccccatcctgggcatccctcaggcacaccgtggcaccggcctggtgctggatggagacaccagctacacataccatctggtgtgcatgggccccgaggccagcggctggggccaggatgagccgcagacatggcccactgaccacagggcccagcagggcgtgcagaggcagggggtgtcctacagcgtgcatgcctacactggccagccgtccccacgggggctccactcggagaacagggaggatgagggttggcaggtttaccgcctgggcgccagggatgcccaccagggacgtccaacatgggcactccgcccagaggacggggaggacaaggagatgaagacctaccgcctggatgctggggacgctgaccccaggaggctgtgtgacctggagcgggagcgctgggccgtcatccagggccaggcagtcaggaagagcagcaccgtggccacgctccagggcactcctgaccacggagaaccccaggacccccgggcccacctcggtccacgcccctggaggagaacgtggttgacagggagcagattgacttcctggcagcgagacagcagttcctgagtctggagcaggcgaacaagggggcccctcatagctccccggccagggggacccctgcaggcacaaccccaggggccagccaggcccccaaggccttcaacaagccccacctggccaacgggcacgtggttcccatcaagccccaggtgaagggggtggtcagggaagagaacaaggtgcgtgctgtgcccacctgggccagtgtccaagttgtggatgaccctggctccttggcctcagtggagtccccggggacccccaaggagacgcccatcgagcgggagatccgtctggctcaggagcgtgaggcagacctgcgagagcagagggggcttcggcaggcaaccgaccaccaggagctggtggaaatccccaccaggccgctgctgaccaagctgagcctgatcacagccccacggcgggagagagggcgcccgtccctctacgtgcagcgggacatagtacaggagacacagcgtgaggaagaccaccggcgggagggcctgcacgtgggccgggcgtccacacccgactgggtctcggagggtccccagcccggactccggagagccctcagctcagattccatcctcagcccggccccagatgcccgtgcggccgacccagctccagaagtgaggaaggtgaaccgcatcccacctgatgcctaccagccgtacctgagccccgggaccccccagctagaattctcagccttcggagcattcggcaagcccagcagtctctccacagcggaggccaaggctgcgacttcaccaaaggccacgatgtccccgaggcatctctcagaatcctctggaaaacccctgagcacaaagcaagaggcatcgaagccccctcggggatgcccgcaagccaacaggggtgtcgtgcggtgggagtacttccgcctgcgtcctctgcggttcagggccccagacgagccccagcaggcccaagtcccccatgtctggggctgggaggtggctggggcccctgcactgaggctgcagaagtcccagtcatctgatctgctggaaagggagagggagagtgtcctgcgccgggagcaagaggtggcagaggagcggagaaatgctctcttcccagaggtcttctccccaacgccagatgagaactctgaccagaactccaggagctcctcccaggcatccggcatcacgggcagttactcggtgtctgagtctcccttcttcagccccatccacctacactcaaacgtggcgtggacagtggaagatccagtggacagtgctcctcccgggcagagaaagaaggagcaatggtacgctggcatcaacccctcggacggtatcaactcagaggtcctggaagccatacgggtgacccgtcacaagaacgccatggcagagcgctgggaatcccgcatctacgccagtgaggaggatgactgagcctcgggatggggcgcccaccccctgccctgccctgaccctcgtgggaactgccaagaccatcgccaagcccccaccctaggaaatgggtcctaggtccaggatccaagaaccacagctcatctgccaacaatcccaccatgggcacatttgggactgttgggtttttcgtttccgtttctatcttcctttagaaatgtttctgcctttggggtctaaagcttttggggatgaaatgggacccctgctgattctttctgcttctaagactttgccaaatgccctgggtctaagaaagaaagagacccgctcctccactttcaggtgtaatttgcttccgctagtctgagggcagagggaccggtcaaagagggtggcacagatcgcagcaccttgaggggctgcgggtctgagggaggagacactcagctcctccctctgagaagtcccaagctgagaggggagacctgcccctttccaaccctgggaaaccatccagtctgagggaggaggccaaactcccagtgctgggggtccctgtgcagccctcaaacccttcaccttggtgcacccagccacacctggtggacacaaagctctcacatcgataggatcccatgaggatggtccccttcacctgggagaaaagtgacccagtttaggagctggaggggggtctttgtcccccacccccaaactgccctgaaataaacctggagtgagctgcc

SEQ ID NO: 345262 - DNA, 346 bp, Homo sapiens
cccatcagatggacgatggccttccaagaccaaggagcccgggcaagagggatggctggtgtcgatggtgcaaaaaggaaacttaggaattcagatgctttgaaaatgaacttttgctggtactgaaaaggaaagagcattctcttcctttagagaatagaggtttgagtgctccggctctgcaaacagtccctacggttggcacgttggtgtgtgcgaggggttcggaggccccagtacatctgatcacctcgcctttttgtgagtttaggtgttcagttttaatcttgttatgcaaaggaacatgtgactctttggaagtagatatagaagagtgcacttttac

SEQ ID NO: 345263 - DNA, 690 bp, Homo sapiens
ttttttttttttttttttttggaaagcaaggatcacacttccccctccctgttccttaatcccttttctaaaaaggggggacctaaatcctgattataggcttttcatttctccgcaaagcctttattttggcagttaagccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaagaagagccgccctttttgaagtgctgaggtttacaggcatgacccctgctttaccgaagattggtccactccatgccccccattaagcttttagaagatgttggtttct

SEQ ID NO: 345264 - DNA, 722 bp, Homo sapiens
  misc_feature (627)..(627): n is a, c, g, or t
ttttttttttttttttttttggaaagcaaggatcacacttccccctccctgttccttaatcccttttctaaaaaggggggaaaatccggatggattttagggattggtctggtgtcagctgtgttttattgcacacctaaatcctgattatagggttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaagaagaaaaacagcactttttgagtgtctgaggtatccagncatgcccattatgagtatcttgagggtgcaggatcagctattcttggaagttcctaagtttacagaagagtggacttcatgcctcgtatagcttt

SEQ ID NO: 345265 - DNA, 395 bp, Homo sapiens
gcggccgcctactactactaaattcgcggccgcgttgtcctcttcagcagtataataagccccttaaggctgaagtaaccttattcctattgtttagtagctaatagcatgcttttgatatgcttatgatcatactaataatttaatatttgaattgtatggaagtacaattcagtatcattttacatatggtatattgtgatgctgtatcatattttatgttacggtttataagaaaagctcctaggtataaaatgctacatagcaggaacttggtttttcaatgttattatttcctactgtttttgacgtaacggcaataaaatttgtttgaaccaaaatggactaacaattatttgtacaactcagtattgtctaaatatcatattgttaaa

SEQ ID NO: 345266 - DNA, 3819 bp, Homo sapiens
ttttttttttttttttttttggaaagcaaggatcacacttccccctccctgttccttaatcccttttctaaaaaggggggaaaatccggatggattttagggattggtctggtgtcagctgtgttttattgcacacctaaatcctgattataggcttttcatttctccgcaaagcctttattttggcagttaagccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaagaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggatgtaattggctgtactcaggagatggatttcattctttggcctcggaatgatattgaaaaaatcgtctgtctcctgttttctaggtggaaagaatctgatgagccttttaggcctgttcaggccaaatttgagtttcatcatggtgactatgaaaaacagtttctgcatgtactgagccgcaaggacaagactggaatcgttgtcaacaatcctaaccagtcagtgtttctcttcattgacagacagcacttgcagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacagaacactatgcattttgaaacttgttcatcctggatttttttaaatcatttttatctcagaacttaaacaaaaattagatgtcgtgcacggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggtcttcccatttgtgctggtttttgcctctttgacatctgtcatcagtatttagagggtgagaagtgaatgtaacaggtataaataacatttttaaaaacaataactttgctataatcacagttgttccagagcactgtcagatacattctaatgaccagaactggtttaaaaaaagaaaatacaaccatgggaaagaaatcttaaatgaaaaacgcatctcattgtaggcatttttgcctcatattttactgggccatgtttgtttcctggtactcatgtattttttttttccagatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttgttttgttttgtttttggttttacagagaagagatttttattacaaagaaaaaaattccagtgaattgtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggtttttttttttttctccttttaaatgaagaaaagctttgcttaagggttgcatacttttattggagtaaatctgaatgatcctactcctttggagtaaaactagtgcttaccagtttccaattgtatttagcttctggttggaatttgaaaaaaaaagaaaaaaagaaaaagaaaacctaaataaaataggtgaaagttccctgactattcaggtgaatacacaaagtttgaagtgttaactttttctttccatttcactgatgttactggtcaccttagagaattatttcatagtctgtggctaaatagtaaattcagaagaaaaatacctggcaattgagtgtgtaacttcaacaagaacaggaatcaagaacatactgtcagctttcaacagttagcaacctggccttatgccttgcttcatgggaaagggccattcttaaatttcaaaatgctttcatgtgtcctcttatttaaaaattagaatctatttgaaataacattttgaatgtttattataaccaggtactcttctaagctcttgtcttaacctctcaacctttggtggaaatagatgcagaggttaagtaacttgctcaagctcagatcataagtagtggaggatttaaaaccaggctggctggctcttaaggcctatgctcttaatttaccatgttgaattaatttaccatattgaattacacttatgttcaccaagttaggcattttggcagccattgtttacgtttttattttggaataatttagaaaagttaccagagtaatatgaaagctgttgtgtaatctttaccctcatttttattattttgccacatttttttcattttctctgtacacttatacctgtgagctatttgagtttgttgcacactttgtgcttccttaccccttccttagtacttcggcatatgttccaagtacaagaatatttcatataactagagtaaaattaccaaactcagggaatgttgatactctttatcatccatattcgttttgttgtcccagtatccttggtagcttgttttagatccccccctctagagtacaggatcattgaatttagttgttctcagttgtctttaatgtggaacagttccttagcctttatgtgttccatgacctctatgttttttggagtacagggcaatttttcttgtaaattgttactcattttgcatttgaattgtttattcatgcttaacgcccttctcaagtatactctccatctgctcttcattgatgttacttttgagcgcctggtcaaggtgtcctggttttgccctatgtgtggtacttactactagcaatctctgggaagcaatgtgcaaataccctgttcctttatcaggagctcccttggcgattctttccagactaaaacccaaaccagtctttaactatgatggttacaaaatagtgattttccaaatctaatgctttgtccatttacagcatttgttgtaagagagtgttctatctctggcatttattatctacctaaacactatggcctcatattttttccctccaaatcataatttgcatgc

SEQ ID NO: 345267 - DNA, 3765 bp, Homo sapiens
ttttttttttttttttttttggaaagcaaggatcacacttccccctccctgttccttaatcccttttctaaaaaggggggaaaatccggatggattttagggattggtctggtgtcagctgtgttttattgcacacctaaatcctgattataggcttttcatttctccgcaaagcctttattttggcagttaagccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaagaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggatgtaattggctgtactcaggagatggatttcattctttggcctcggaatgatattgaaaaaatcgtctgtctcctgttttctaggtggaaagaatctgatgagccttttaggcctgttcaggccaaatttgagtttcatcatggtgactatgaaaaacagtttctgcatgtactgagccgcaaggacaagactggaatcgttgtcaacaatcctaaccagtcagtgtttctcttcattgacagacagcacttgcagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacagaacactatgcattttgaaacttgttcatcctggatttttttaaatcatttttatctcagaacttaaacaaaaattagatgtcgtgcacggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggtcttcccatttgtgctggtttttgcctctttgacatctgtcatcagtatttagagggtgagaagtgaatgtaacaggtataaataacatttttaaaaacaataactttgctataatcacagttgttccagagcactgtcagatacattctaatgaccagaactggtttaaaaaaagaaaatacaaccatgggaaagaaatcttaaatgaaaaacgcatctcattgtaggcatttttgcctcatattttactgggccatgtttgtttcctggtactcatgtattttttttttccagatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttgttttgttttgtttttggttttacagagaagagatttttattacaaagaaaaaaattccagtgaattgtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggtttttttttttttctccttttaaatgaagaaaagctttgcttaagggttgcatacttttattggagtaaatctgaatgatcctactcctttggagtaaaactagtgcttaccagtttccaattgtatttagcttctggttggaatttgaaaaaaaaagaaaaaaagaaaaagaaaacctaaataaaataggtgaaagttccctgactattcaggtgaatacacaaagtttgaagtgttaactttttctttccatttcactgatgttactggtcaccttagagaattatttcatagtctgtggctaaatagtaaattcagaagaaaaatacctggcaattgagtgtgtaacttcaacaagaacaggaatcaagaacatactgtcagctttcaacagttagcaacctggccttatgccttgcttcatgggaaagggccattcttaaatttcaaaatgctttcatgtgtcctcttatttaaaaattagaatctatttgaaataacattttgaatgtttattataaccaggtactcttctaagctcttgtcttaacctctcaacctttggtggaaatagatgcagaggttaagtaacttgctcaagctcagatcataagtagtggaggatttaaaaccaggctggctggctcttaaggcctatgctcttaatttaccatgttgaattaatttaccatattgaattacacttatgttcaccaagttaggcattttggcagccattgtttacgtttttattttggaataatttagaaaagttaccagagtaatatgaaagctgttgtgtaatctttaccctcatttttattattttgccacatttttttcattttctctgtacacttatacctgtgagctatttgagtttgttgcacactttgtgcttccttaccccttccttagtacttcggcatatgttccaagtacaagaatatttcatataactagagtttgtcccagtatccttggtagcttgttttagatccccccctctagagtacaggatcattgaatttagttgttctcagttgtctttaatgtggaacagttccttagcctttatgtgttccatgacctctatgttttttggagtacagggcaatttttcttgtaaattgttactcattttgcatttgaattgtttattcatgcttaacgcccttctcaagtatactctccatctgctcttcattgatgttacttttgagcgcctggtcaaggtgtcctggttttgccctatgtgtggtacttactactagcaatctctgggaagcaatgtgcaaataccctgttcctttatcaggagctcccttggcgattctttccagactaaaacccaaaccagtctttaactatgatggttacaaaatagtgattttccaaatctaatgctttgtccatttacagcatttgttgtaagagagtgttctatctctggcatttattatctacctaaacactatggcctcatattttttccctccaaatcataatttgcatgc

SEQ ID NO: 345268 - DNA, 3765 bp, Homo sapiens
ttttttttttttttttttttggaaagcaaggatcacacttccccctccctgttccttaatcccttttctaaaaaggggggacctaaatcctgattataggcttttcatttctccgcaaagcctttattttggcagttaagccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaagaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggatgtaattggctgtactcaggagatggatttcattctttggcctcggaatgatattgaaaaaatcgtctgtctcctgttttctaggtggaaagaatctgatgagccttttaggcctgttcaggccaaatttgagtttcatcatggtgactatgaaaaacagtttctgcatgtactgagccgcaaggacaagactggaatcgttgtcaacaatcctaaccagtcagtgtttctcttcattgacagacagcacttgcagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacagaacactatgcattttgaaacttgttcatcctggatttttttaaatcatttttatctcagaacttaaacaaaaattagatgtcgtgcacggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggtcttcccatttgtgctggtttttgcctctttgacatctgtcatcagtatttagagggtgagaagtgaatgtaacaggtataaataacatttttaaaaacaataactttgctataatcacagttgttccagagcactgtcagatacattctaatgaccagaactggtttaaaaaaagaaaatacaaccatgggaaagaaatcttaaatgaaaaacgcatctcattgtaggcatttttgcctcatattttactgggccatgtttgtttcctggtactcatgtattttttttttccagatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttgttttgttttgtttttggttttacagagaagagatttttattacaaagaaaaaaattccagtgaattgtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggtttttttttttttctccttttaaatgaagaaaagctttgcttaagggttgcatacttttattggagtaaatctgaatgatcctactcctttggagtaaaactagtgcttaccagtttccaattgtatttagcttctggttggaatttgaaaaaaaaagaaaaaaagaaaaagaaaacctaaataaaataggtgaaagttccctgactattcaggtgaatacacaaagtttgaagtgttaactttttctttccatttcactgatgttactggtcaccttagagaattatttcatagtctgtggctaaatagtaaattcagaagaaaaatacctggcaattgagtgtgtaacttcaacaagaacaggaatcaagaacatactgtcagctttcaacagttagcaacctggccttatgccttgcttcatgggaaagggccattcttaaatttcaaaatgctttcatgtgtcctcttatttaaaaattagaatctatttgaaataacattttgaatgtttattataaccaggtactcttctaagctcttgtcttaacctctcaacctttggtggaaatagatgcagaggttaagtaacttgctcaagctcagatcataagtagtggaggatttaaaaccaggctggctggctcttaaggcctatgctcttaatttaccatgttgaattaatttaccatattgaattacacttatgttcaccaagttaggcattttggcagccattgtttacgtttttattttggaataatttagaaaagttaccagagtaatatgaaagctgttgtgtaatctttaccctcatttttattattttgccacatttttttcattttctctgtacacttatacctgtgagctatttgagtttgttgcacactttgtgcttccttaccccttccttagtacttcggcatatgttccaagtacaagaatatttcatataactagagtaaaattaccaaactcagggaatgttgatactctttatcatccatattcgttttgttgtcccagtatccttggtagcttgttttagatccccccctctagagtacaggatcattgaatttagttgttctcagttgtctttaatgtggaacagttccttagcctttatgtgttccatgacctctatgttttttggagtacagggcaatttttcttgtaaattgttactcattttgcatttgaattgtttattcatgcttaacgcccttctcaagtatactctccatctgctcttcattgatgttacttttgagcgcctggtcaaggtgtcctggttttgccctatgtgtggtacttactactagcaatctctgggaagcaatgtgcaaataccctgttcctttatcaggagctcccttggcgattctttccagactaaaacccaaaccagtctttaactatgatggttacaaaatagtgattttccaaatctaatgctttgtccatttacagcatttgttgtaagagagtgttctatctctggcatttattatctacctaaacactatggcctcatattttttccctccaaatcataatttgcatgc

SEQ ID NO: 345269 - DNA, 3666 bp, Homo sapiens
gactacatacttccgcagtacttccggactacatactcccgccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaagaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggatgtaattggctgtactcaggagatggatttcattctttggcctcggaatgatattgaaaaaatcgtctgtctcctgttttctaggtggaaagaatctgatgagccttttaggcctgttcaggccaaatttgagtttcatcatggtgactatgaaaaacagtttctgcatgtactgagccgcaaggacaagactggaatcgttgtcaacaatcctaaccagtcagtgtttctcttcattgacagacagcacttgcagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacagaacactatgcattttgaaacttgttcatcctggatttttttaaatcatttttatctcagaacttaaacaaaaattagatgtcgtgcacggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggtcttcccatttgtgctggtttttgcctctttgacatctgtcatcagtatttagagggtgagaagtgaatgtaacaggtataaataacatttttaaaaacaataactttgctataatcacagttgttccagagcactgtcagatacattctaatgaccagaactggtttaaaaaaagaaaatacaaccatgggaaagaaatcttaaatgaaaaacgcatctcattgtaggcatttttgcctcatattttactgggccatgtttgtttcctggtactcatgtattttttttttccagatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttgttttgttttgtttttggttttacagagaagagatttttattacaaagaaaaaaattccagtgaattgtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggtttttttttttttctccttttaaatgaagaaaagctttgcttaagggttgcatacttttattggagtaaatctgaatgatcctactcctttggagtaaaactagtgcttaccagtttccaattgtatttagcttctggttggaatttgaaaaaaaaagaaaaaaagaaaaagaaaacctaaataaaataggtgaaagttccctgactattcaggtgaatacacaaagtttgaagtgttaactttttctttccatttcactgatgttactggtcaccttagagaattatttcatagtctgtggctaaatagtaaattcagaagaaaaatacctggcaattgagtgtgtaacttcaacaagaacaggaatcaagaacatactgtcagctttcaacagttagcaacctggccttatgccttgcttcatgggaaagggccattcttaaatttcaaaatgctttcatgtgtcctcttatttaaaaattagaatctatttgaaataacattttgaatgtttattataaccaggtactcttctaagctcttgtcttaacctctcaacctttggtggaaatagatgcagaggttaagtaacttgctcaagctcagatcataagtagtggaggatttaaaaccaggctggctggctcttaaggcctatgctcttaatttaccatgttgaattaatttaccatattgaattacacttatgttcaccaagttaggcattttggcagccattgtttacgtttttattttggaataatttagaaaagttaccagagtaatatgaaagctgttgtgtaatctttaccctcatttttattattttgccacatttttttcattttctctgtacacttatacctgtgagctatttgagtttgttgcacactttgtgcttccttaccccttccttagtacttcggcatatgttccaagtacaagaatatttcatataactagagtaaaattaccaaactcagggaatgttgatactctttatcatccatattcgttttgttgtcccagtatccttggtagcttgttttagatccccccctctagagtacaggatcattgaatttagttgttctcagttgtctttaatgtggaacagttccttagcctttatgtgttccatgacctctatgttttttggagtacagggcaatttttcttgtaaattgttactcattttgcatttgaattgtttattcatgcttaacgcccttctcaagtatactctccatctgctcttcattgatgttacttttgagcgcctggtcaaggtgtcctggttttgccctatgtgtggtacttactactagcaatctctgggaagcaatgtgcaaataccctgttcctttatcaggagctcccttggcgattctttccagactaaaacccaaaccagtctttaactatgatggttacaaaatagtgattttccaaatctaatgctttgtccatttacagcatttgttgtaagagagtgttctatctctggcatttattatctacctaaacactatggcctcatattttttccctccaaatcataatttgcatgc

SEQ ID NO: 345270 - DNA, 3406 bp, Homo sapiens
cagatttattttttttttttcttagaaacagcaattaacaatgtgactcctaatcaaaagaaaagagatgtccttggggcttaaagtactatggtgggagtcttggactgagtaggtttgaaaatacaattttatgatcgtggagtactaggatttagtcattttgatgcagagcatttcctgatcaactgctgttgtggagtgtactgtccaatagaattctctacaattaaggaaatgttctgtatctcaagagattgttcttaatggtggccagtagtcatgtgaccgttgagcatttgaaatgtggctagtgctactgaagaatggaattgtaaattgcttttaatctaaattttgcctgtgatattattggctgtgggtttgccaaaatttgtttttttaaagaggaaaagataacggactgttggctgctttattggacagcacagctagcatatagatgcagataggtagtataacttgtttgtagtttaatataaatgttgtattttgtaattaggccaaatttgagtttcatcatggtgactatgaaaaacagtttctgcatgtactgagccgcaaggacaagactggaatcgttgtcaacaatcctaaccagtcagtgtttctcttcattgacagacagcacttgcagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacagaacactatgcattttgaaacttgttcatcctggatttttttaaatcatttttatctcagaacttaaacaaaaattagatgtcgtgcacggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggtcttcccatttgtgctggtttttgcctctttgacatctgtcatcagtatttagagggtgagaagtgaatgtaacaggtataaataacatttttaaaaacaataactttgctataatcacagttgttccagagcactgtcagatacattctaatgaccagaactggtttaaaaaaagaaaatacaaccatgggaaagaaatcttaaatgaaaaacgcatctcattgtaggcatttttgcctcatattttactgggccatgtttgtttcctggtactcatgtattttttttttccagatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttgttttgttttgtttttggttttacagagaagagatttttattacaaagaaaaaaattccagtgaattgtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggtttttttttttttctccttttaaatgaagaaaagctttgcttaagggttgcatacttttattggagtaaatctgaatgatcctactcctttggagtaaaactagtgcttaccagtttccaattgtatttagcttctggttggaatttgaaaaaaaaagaaaaaaagaaaaagaaaacctaaataaaataggtgaaagttccctgactattcaggtgaatacacaaagtttgaagtgttaactttttctttccatttcactgatgttactggtcaccttagagaattatttcatagtctgtggctaaatagtaaattcagaagaaaaatacctggcaattgagtgtgtaacttcaacaagaacaggaatcaagaacatactgtcagctttcaacagttagcaacctggccttatgccttgcttcatgggaaagggccattcttaaatttcaaaatgctttcatgtgtcctcttatttaaaaattagaatctatttgaaataacattttgaatgtttattataaccaggtactcttctaagctcttgtcttaacctctcaacctttggtggaaatagatgcagaggttaagtaacttgctcaagctcagatcataagtagtggaggatttaaaaccaggctggctggctcttaaggcctatgctcttaatttaccatgttgaattaatttaccatattgaattacacttatgttcaccaagttaggcattttggcagccattgtttacgtttttattttggaataatttagaaaagttaccagagtaatatgaaagctgttgtgtaatctttaccctcatttttattattttgccacatttttttcattttctctgtacacttatacctgtgagctatttgagtttgttgcacactttgtgcttccttaccccttccttagtacttcggcatatgttccaagtacaagaatatttcatataactagagtaaaattaccaaactcagggaatgttgatactctttatcatccatattcgttttgttgtcccagtatccttggtagcttgttttagatccccccctctagagtacaggatcattgaatttagttgttctcagttgtctttaatgtggaacagttccttagcctttatgtgttccatgacctctatgttttttggagtacagggcaatttttcttgtaaattgttactcattttgcatttgaattgtttattcatgcttaacgcccttctcaagtatactctccatctgctcttcattgatgttacttttgagcgcctggtcaaggtgtcctggttttgccctatgtgtggtacttactactagcaatctctgggaagcaatgtgcaaataccctgttcctttatcaggagctcccttggcgattctttccagactaaaacccaaaccagtctttaactatgatggttacaaaatagtgattttccaaatctaatgctttgtccatttacagcatttgttgtaagagagtgttctatctctggcatttattatctacctaaacactatggcctcatattttttccctccaaatcataatttgcatgc

SEQ ID NO: 345271 - DNA, 2270 bp, Homo sapiens
  misc_feature (2248)..(2249): n is a, c, g, or t
  misc_feature (2252)..(2253): n is a, c, g, or t
ttttttttttttttttttttggaaagcaaggatcacacttccccctccctgttccttaatcccttttctaaaaaggggggaaaatccggatggattttagggattggtctggtgtcagctgtgttttattgcacacctaaatcctgattataggcttttcatttctccgcaaagcctttattttggcagttaagccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaagaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggatgtaattggctgtactcaggagatggatttcattctttggcctcggaatgatattgaaaaaatcgtctgtctcctgttttctaggtggaaagaatctgatgagccttttaggcctgttcaggccaaatttgagtttcatcatggtgactatgaaaaacagtttctgcatgtactgagccgcaaggacaagactggaatcgttgtcaacaatcctaaccagtcagtgtttctcttcattgacagacagcacttgcagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacagaacactatgcattttgaaacttgttcatcctggatttttttaaatcatttttatctcagaacttaaacaaaaattagatgtcgtgcacggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggtcttcccatttgtgctggtttttgcctctttgacatctgtcatcagtatttagagggtgagaagtgaatgtaacaggtataaataacatttttaaaaacaataactttgctataatcacagttgttccagagcactgtcagatacattctaatgaccagaactggtttaaaaaaagaaaatacaaccatgggaaagaaatcttaaatgaaaaacgcatctcattgtaggcatttttgcctcatattttactgggccatgtttgtttcctggtactcatgtattttttttttccagatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttgttttgttttgtttttggttttacagagaagagatttttattacaaagaaaaaaattccagtgaattgtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtatatannaanncatatcgggtcgagctg

SEQ ID NO: 345272 - DNA, 3640 bp, Homo sapiens
aagtatattacatatgtataggtttatttacatttgtaggctacttcagacatcttcaaagtcagagtccttattttgccttttagaggtgctagatagtgaagaaaagatgaactttgtaattaagttggatgttcaaatggtaactactttttaaaaataagggttttgatttaactggtaatactttggcttttttctagtcccttaccccaggatatgcttaaatcttttatttattttttgagacaaggtctcaactctgtcaccacgctggagtacactggcatatggatcatggctcaccgcagccttgacctcctgggcgcaggttatccacctcagcttcccgagtggctggactacaggcgtgtgccaccacatccagctaatttttatattttttgtagagatgggttttcgtcatgttgcccagaatggtcttgaactcttgggctcaagcaatcctcctgactcagcctcccaaagtgctgggattacaggtctgagccaccacacccagccttaaatttttacctattccttcatcctctcactagcttctattcttaccacatctgctttatcttcctctatataaaaatgacttcaaacttctcaaaatctgtccccatgaaatgcctttagctttaatttcttctagcaagtagtctctggtttacttccctaactttttatcttctaattctgcataaatttttcctttatcttatatggcaagattttgtctgtctagaatatggatagggactacaatttgtcccttactctgtatgttaagatgtttaataaattgtgggaaatggacttcatgtgacagttacgctaaagtcttatttttaaaaaatattaaaatgttttccccttccagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacagaacactatgcattttgaaacttgttcatcctggatttttttaaatcatttttatctcagaacttaaacaaaaattagatgtcgtgcacggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggtcttcccatttgtgctggtttttgcctctttgacatctgtcatcagtatttagagggtgagaagtgaatgtaacaggtataaataacatttttaaaaacaataactttgctataatcacagttgttccagagcactgtcagatacattctaatgaccagaactggtttaaaaaaagaaaatacaaccatgggaaagaaatcttaaatgaaaaacgcatctcattgtaggcatttttgcctcatattttactgggccatgtttgtttcctggtactcatgtattttttttttccagatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttgttttgttttgtttttggttttacagagaagagatttttattacaaagaaaaaaattccagtgaattgtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggtttttttttttttctccttttaaatgaagaaaagctttgcttaagggttgcatacttttattggagtaaatctgaatgatcctactcctttggagtaaaactagtgcttaccagtttccaattgtatttagcttctggttggaatttgaaaaaaaaagaaaaaaagaaaaagaaaacctaaataaaataggtgaaagttccctgactattcaggtgaatacacaaagtttgaagtgttaactttttctttccatttcactgatgttactggtcaccttagagaattatttcatagtctgtggctaaatagtaaattcagaagaaaaatacctggcaattgagtgtgtaacttcaacaagaacaggaatcaagaacatactgtcagctttcaacagttagcaacctggccttatgccttgcttcatgggaaagggccattcttaaatttcaaaatgctttcatgtgtcctcttatttaaaaattagaatctatttgaaataacattttgaatgtttattataaccaggtactcttctaagctcttgtcttaacctctcaacctttggtggaaatagatgcagaggttaagtaacttgctcaagctcagatcataagtagtggaggatttaaaaccaggctggctggctcttaaggcctatgctcttaatttaccatgttgaattaatttaccatattgaattacacttatgttcaccaagttaggcattttggcagccattgtttacgtttttattttggaataatttagaaaagttaccagagtaatatgaaagctgttgtgtaatctttaccctcatttttattattttgccacatttttttcattttctctgtacacttatacctgtgagctatttgagtttgttgcacactttgtgcttccttaccccttccttagtacttcggcatatgttccaagtacaagaatatttcatataactagagtaaaattaccaaactcagggaatgttgatactctttatcatccatattcgttttgttgtcccagtatccttggtagcttgttttagatccccccctctagagtacaggatcattgaatttagttgttctcagttgtctttaatgtggaacagttccttagcctttatgtgttccatgacctctatgttttttggagtacagggcaatttttcttgtaaattgttactcattttgcatttgaattgtttattcatgcttaacgcccttctcaagtatactctccatctgctcttcattgatgttacttttgagcgcctggtcaaggtgtcctggttttgccctatgtgtggtacttactactagcaatctctgggaagcaatgtgcaaataccctgttcctttatcaggagctcccttggcgattctttccagactaaaacccaaaccagtctttaactatgatggttacaaaatagtgattttccaaatctaatgctttgtccatttacagcatttgttgtaagagagtgttctatctctggcatttattatctacctaaacactatggcctcatattttttccctccaaatcataatttgcatgc

SEQ ID NO: 345273 - DNA, 1337 bp, Homo sapiens
ttttttttttttttttttttggaaagcaaggatcacacttccccctccctgttccttaatcccttttctaaaaaggggggaaaatccggatggattttagggattggtctggtgtcagctgtgttttattgcacacctaaatcctgattataggcttttcatttctccgcaaagcctttattttggcagttaagccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaagaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggatgtaattggctgtactcaggagatggatttcattctttggcctcggaatgatattgaaaaaatcgtctgtctcctgttttctaggtggaaagaatctgatgagccttttaggcctgttcaggccaaatttgagtttcatcatggtgactatgaaaaacagtttctgcatgtactgagccgcaaggacaagactggaatcgttgtcaacaatcctaaccagtcagtgtttctcttcattgacagacagcacttgcagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacaactgtcgaattcggtaccgagctcgatcatc

SEQ ID NO: 345274 - DNA, 1776 bp, Homo sapiens
gcggccgcctactactactaaattcgcggccgcgaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggtttttttttttttctccttttaaatgaagaaaagctttgcttaagggttgcatacttttattggagtaaatctgaatgatcctactcctttggagtaaaactagtgcttaccagtttccaattgtatttagcttctggttggaatttgaaaaaaaaagaaaaaaagaaaaagaaaacctaaataaaataggtgaaagttccctgactattcaggtgaatacacaaagtttgaagtgttaactttttctttccatttcactgatgttactggtcaccttagagaattatttcatagtctgtggctaaatagtaaattcagaagaaaaatacctggcaattgagtgtgtaacttcaacaagaacaggaatcaagaacatactgtcagctttcaacagttagcaacctggccttatgccttgcttcatgggaaagggccattcttaaatttcaaaatgctttcatgtgtcctcttatttaaaaattagaatctatttgaaataacattttgaatgtttattataaccaggtactcttctaagctcttgtcttaacctctcaacctttggtggaaatagatgcagaggttaagtaacttgctcaagctcagatcataagtagtggaggatttaaaaccaggctggctggctcttaaggcctatgctcttaatttaccatgttgaattaatttaccatattgaattacacttatgttcaccaagttaggcattttggcagccattgtttacgtttttattttggaataatttagaaaagttaccagagtaatatgaaagctgttgtgtaatctttaccctcatttttattattttgccacatttttttcattttctctgtacacttatacctgtgagctatttgagtttgttgcacactttgtgcttccttaccccttccttagtacttcggcatatgttccaagtacaagaatatttcatataactagagtaaaattaccaaactcagggaatgttgatactctttatcatccatattcgttttgttgtcccagtatccttggtagcttgttttagatccccccctctagagtacaggatcattgaatttagttgttctcagttgtctttaatgtggaacagttccttagcctttatgtgttccatgacctctatgttttttggagtacagggcaatttttcttgtaaattgttactcattttgcatttgaattgtttattcatgcttaacgcccttctcaagtatactctccatctgctcttcattgatgttacttttgagcgcctggtcaaggtgtcctggttttgccctatgtgtggtacttactactagcaatctctgggaagcaatgtgcaaataccctgttcctttatcaggagctcccttggcgattctttccagactaaaacccaaaccagtctttaactatgatggttacaaaatagtgattttccaaatctaatgctttgtccatttacagcatttgttgtaagagagtgttctatctctggcatttattatctacctaaacactatggcctcatattttttccctccaaatcataatttgcatgc

SEQ ID NO: 345275 - DNA, 443 bp, Homo sapiens
agtcagcgtttatcagattacttaccattactactttgtcctggggaaatcctcttaatctttaaaggcgcaatccaaaatcataatgttcccgtgttacttactgttacttttttttttttctcctatagtggtttgatgataagaacccaatttgggccgggcgcggttgctcacgcctgtaatcccaacactttgggaggctaagccagatggatcacctgaggtcgggagtttgagaccatcctgaccaacataaagaagtcctatctctactaaaaacacaaaattagctgggcgtggtggtgcatgcctgtattccagctacttgggaggctgaggcagaagaatcgcttgaacccaggaggcggaggttgcagtgagccgagatcgcgccattgcactccagcctgggcaacaagagcgaaattccgtctcaagaa

SEQ ID NO: 345276 - DNA, 2736 bp, Homo sapiens
ttttttttttttttttttttggaaagcaaggatcacacttccccctccctgttccttaatcccttttctaaaaaggggggaaaatccggatggattttagggattggtctggtgtcagctgtgttttattgcacacctaaatcctgattataggcttttcatttctccgcaaagcctttattttggcagttaagccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaagaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggatgtaattggctgtactcaggagatggatttcattctttggcctcggaatgatattgaaaaaatcgtctgtctcctgttttctaggtggaaagaatctgatgagccttttaggcctgttcaggccaaatttgagtttcatcatggtgactatgaaaaacagtttctgcatgtactgagccgcaaggacaagactggaatcgttgtcaacaatcctaaccagtcagtgtttctcttcattgacagacagcacttgcagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacagaacactatgcattttgaaacttgttcatcctggatttttttaaatcatttttatctcagaacttaaacaaaaattagatgtcgtgcacggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggtcttcccatttgtgctggtttttgcctctttgacatctgtcatcagtatttagagggtgagaagtgaatgtaacaggtataaataacatttttaaaaacaataactttgctataatcacagttgttccagagcactgtcagatacattctaatgaccagaactggtttaaaaaaagaaaatacaaccatgggaaagaaatcttaaatgaaaaacgcatctcattgtaggcatttttgcctcatattttactgggccatgtttgtttcctggtactcatgtattttttttttccagatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttgttttgttttgtttttggttttacagagaagagatttttattacaaagaaaaaaattccagtgaattgtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggtttttttttttttctccttttaaatgaagaaaagctttgcttaagggttgcatacttttattggagtaaatctgaatgatcctactcctttggagtaaaactagtgcttaccagtttccaattgtatttagcttctggttggaatttgaaaaaaaaagaaaaaaagaaaaagaaaacctaaataaaataggtgaaagttccctgactattcaggtgaatcaccaaaaaaaaaaaaaaaagcacaaacacaaacgaagaaccacacaaaagaaaaaaaaaactctccccaacgcgggagacgtccgcggcaaacaaagagcgcacgatcaccccaagagagggggcgccgcagaaaccaccaatttgtttgacccacctataaggagagcggaaaaaccacaaccgttgtgcgcgacaaaccacgggcacaaacagctgcccaccgggtgtcaaacactgtgtaccaccgcgcacaaatattcaccaaaa

SEQ ID NO: 345277 - DNA, 4178 bp, Homo sapiens
ttttttttttttttttttttggaaagcaaggatcacacttccccctccctgttccttaatcccttttctaaaaaggggggaaaatccggatggattttagggattggtctggtgtcagctgtgttttattgcacacctaaatcctgattataggcttttcatttctccgcaaagcctttattttggcagttaagccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaagaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggatgtaattggctgtactcaggagatggatttcattctttggcctcggaatgatattgaaaaaatcgtctgtctcctgttttctaggtggaaagaatctgatgagccttttaggcctgttcaggtattttggtctaaagtgtgatgagtatttcaatatgtgaaaactactagaatataatagggtctaacttgagaaattctttgggaaaatggtttctgatagttttatttcacgagtctcccctatttagaatattgtgatgcaagagaagaaagcgtttggattatagaatctgcttgacagtgtggtggttccacctgcccagtgtggctttgaaattatgactagagaaaatcttttaaagtggacatttactgatttatagaggggcccacagatgagcttctgagatctgtaactcttgaagccttcaccacacatccttctaaaaccgtatatttaactgctgcttcccaaaggccaaatttgagtttcatcatggtgactatgaaaaacagtttctgcatgtactgagccgcaaggacaagactggaatcgttgtcaacaatcctaaccagtcagtgtttctcttcattgacagacagcacttgcagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacagaacactatgcattttgaaacttgttcatcctggatttttttaaatcatttttatctcagaacttaaacaaaaattagatgtcgtgcacggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggtcttcccatttgtgctggtttttgcctctttgacatctgtcatcagtatttagagggtgagaagtgaatgtaacaggtataaataacatttttaaaaacaataactttgctataatcacagttgttccagagcactgtcagatacattctaatgaccagaactggtttaaaaaaagaaaatacaaccatgggaaagaaatcttaaatgaaaaacgcatctcattgtaggcatttttgcctcatattttactgggccatgtttgtttcctggtactcatgtattttttttttccagatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttgttttgttttgtttttggttttacagagaagagatttttattacaaagaaaaaaattccagtgaattgtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggtttttttttttttctccttttaaatgaagaaaagctttgcttaagggttgcatacttttattggagtaaatctgaatgatcctactcctttggagtaaaactagtgcttaccagtttccaattgtatttagcttctggttggaatttgaaaaaaaaagaaaaaaagaaaaagaaaacctaaataaaataggtgaaagttccctgactattcaggtgaatacacaaagtttgaagtgttaactttttctttccatttcactgatgttactggtcaccttagagaattatttcatagtctgtggctaaatagtaaattcagaagaaaaatacctggcaattgagtgtgtaacttcaacaagaacaggaatcaagaacatactgtcagctttcaacagttagcaacctggccttatgccttgcttcatgggaaagggccattcttaaatttcaaaatgctttcatgtgtcctcttatttaaaaattagaatctatttgaaataacattttgaatgtttattataaccaggtactcttctaagctcttgtcttaacctctcaacctttggtggaaatagatgcagaggttaagtaacttgctcaagctcagatcataagtagtggaggatttaaaaccaggctggctggctcttaaggcctatgctcttaatttaccatgttgaattaatttaccatattgaattacacttatgttcaccaagttaggcattttggcagccattgtttacgtttttattttggaataatttagaaaagttaccagagtaatatgaaagctgttgtgtaatctttaccctcatttttattattttgccacatttttttcattttctctgtacacttatacctgtgagctatttgagtttgttgcacactttgtgcttccttaccccttccttagtacttcggcatatgttccaagtacaagaatatttcatataactagagtaaaattaccaaactcagggaatgttgatactctttatcatccatattcgttttgttgtcccagtatccttggtagcttgttttagatccccccctctagagtacaggatcattgaatttagttgttctcagttgtctttaatgtggaacagttccttagcctttatgtgttccatgacctctatgttttttggagtacagggcaatttttcttgtaaattgttactcattttgcatttgaattgtttattcatgcttaacgcccttctcaagtatactctccatctgctcttcattgatgttacttttgagcgcctggtcaaggtgtcctggttttgccctatgtgtggtacttactactagcaatctctgggaagcaatgtgcaaataccctgttcctttatcaggagctcccttggcgattctttccagactaaaacccaaaccagtctttaactatgatggttacaaaatagtgattttccaaatctaatgctttgtccatttacagcatttgttgtaagagagtgttctatctctggcatttattatctacctaaacactatggcctcatattttttccctccaaatcataatttgcatgc

SEQ ID NO: 345278 - DNA, 1682 bp, Homo sapiens
ttttttttttttttttttttggaaagcaaggatcacacttccccctccctgttccttaatcccttttctaaaaaggggggaaaatccggatggattttagggattggtctggtgtcagctgtgttttattgcacacctaaatcctgattataggcttttcatttctccgcaaagcctttattttggcagttaagccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaagaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggatgtaattggctgtactcaggagatggatttcattctttggcctcggaatgatattgaaaaaatcgtctgtctcctgttttctaggtggaaagaatctgatgagccttttaggcctgttcaggccaaatttgagtttcatcatggtgactatgaaaaacagtttctgcatgtactgagccgcaaggacaagactggaatcgttgtcaacaatcctaaccagtcagtgtttctcttcattgacagacagcacttgcagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacagaacactatgcattttgaaacttgttcatcctggatttttttaaatcatttttatctcagaacttaaacaaaaattagatgtcgtgcacggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggtcttcccatttgtgctggtttttgcctctttgacatctgtcatcagtatttagagggtgagataaaaatgatttaaaaaaatccaggatgaacaagtttcaaaatgcatagtgttctgtgcatgagtccattttctttaaactcgtcgac

SEQ ID NO: 345279 - DNA, 1634 bp, Homo sapiens
ttttttttttttttttttttggaaagcaaggatcacacttccccctccctgttccttaatcccttttctaaaaaggggggaaaatccggatggattttagggattggtctggtgtcagctgtgttttattgcacacctaaatcctgattataggcttttcatttctccgcaaagcctttattttggcagttaagccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaagaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggatgtaattggctgtactcaggagatggatttcattctttggcctcggaatgatattgaaaaaatcgtctgtctcctgttttctaggtggaaagaatctgatgagccttttaggcctgttcagtggtttgatgataagaacccaatttgggccgggcgcggttgctcacgcctgtaatcccaacactttgggaggctaagccagatggatcacctgaggtcgggagtttgagaccatcctgaccaacataaagaagtcctatctctactaaaaacacaaaattagctgggcgtggtggtgcatgcctgtattccagctacttgggaggctgaggcagaagaatcgcttgaacccaggaggcggaggttgcagtgagccgagatcgcgccattgcactccagcctgggcaacaagagcgaaattccgtctcaagaaaaaaaaaaaaattggagttttacagataaccacatcttattctgggaaaggatttgaagcaagttgggttttatatttggctgtacttgtcctcttcagcagtataataagccccttaaggctgaagtaaccttattcctattgtttagtagctaatagcatgcttttgatatgcttatgatcatactaataatttaatatttgaattgtatggaagtacaattcagtatcattttacatatggtatattgtgatgctgtatcatattttatgttacggtttataagaaaagctcctaggtataaaatgctacatagcaggaacttggtttttcaatgttattatttcctactgtttttgacgtaacggcaataaaatttgtttga

SEQ ID NO: 345280 - DNA, 1695 bp, Homo sapiens
ttttttttttttttttttttggaaagcaaggatcacacttccccctccctgttccttaatcccttttctaaaaaggggggaaaatccggatggattttagggattggtctggtgtcagctgtgttttattgcacacctaaatcctgattataggcttttcatttctccgcaaagcctttattttggcagttaagccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaagaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggatgtaattggctgtactcaggagatggatttcattctttggcctcggaatgatattgaaaaaatcgtctgtctcctgttttctaggtggaaagaatctgatgagccttttaggcctgttcagtggtttgatgataagaacccaatttgggccgggcgcggttgctcacgcctgtaatcccaacactttgggaggctaagccagatggatcacctgaggtcgggagtttgagaccatcctgaccaacataaagaagtcctatctctactaaaaacacaaaattagctgggcgtggtggtgcatgcctgtattccagctacttgggaggctgaggcagaagaatcgcttgaacccaggaggcggaggttgcagtgagccgagatcgcgccattgcactccagcctgggcaacaagagcgaaattccgtctcaagaaaaaaaaaaaaattggagttttacagataaccacatcttattctgggaaaggatttgaagcaagttgggttttatatttggctgtacttgtcctcttcagcagtataataagccccttaaggctgaagtaaccttattcctattgtttagtagctaatagcatgcttttgatatgcttatgatcatactaataatttaatatttgaattgtatggaagtacaattcagtatcattttacatatggtatattgtgatgctgtatcatattttatgttacggtttataagaaaagctcctaggtataaaatgctacatagcaggaacttggtttttcaatgttattatttcctactgtttttgacgtaacggcaataaaatttgtttgaaccaaaatggactaacaattatttgtacaactcagtattgtctaaatatcatattgttaaa

SEQ ID NO: 345281 - DNA, 457 bp, Homo sapiens
gttgtaattatgaacagggtgaccaggataggacttagtgttacaatatatgtaagtaaagaactgaagaaagagaaggaaggagttccttgttgctcaactcacaattactacataccacttaacataatgtctcacacaagctggcactaaataatattttttaatatatgaacaaggaaataaatagaggaaggtggattatttgtaaatgccttattaactacggcagaatcataatgagcatttcctatagaacaaagtcatctgcctgtgattttttcacttatttttgggtagctcaatagagccacaaagtgaagagagcaataattatgtggccaccagagctgctattagagtgtcacctgttgttctatccattgtctcaaagacagttttaaaaaagaccctatacgcttcattaagagcatttgttcactgtggggtggaggct

SEQ ID NO: 345282 - DNA, 602 bp, Homo sapiens
agacggtgtttcaccaagttggccaggatggtcttgatctcttgacctcgtgatccacctgccttggcctccctgaatgctaggattacaggcatgagccaccatgcccagccccataagggtcacttttaaaaagacgattgcctatggtttctctgtgaaaatagtccatttgaacttgtttgatgtaatttggacacatttggcagaaattacacactcatttttggctttgtttagttttaacttttttttttttagacggagttttgctcttattgcccaggcatgcaccaccatgcctggctaattttgtatttttagtagagagggggtttctccatgttagtcaggctggtctggaactcccaacctcagttgatcctcccgccttggcgtcccaaagtaccagattacagatgtgagccactgcacctggccatttttttttgaaggcagggtctctctgtcctagactggagtgcagtggcacgattatggctcactgcagccttgacttcagtctcatgtgatccttccacctcagcctcccaagtagcaggtactgtaggtactgtcacaagtattataggcatcaagcc

SEQ ID NO: 345283 - DNA, 749 bp, Homo sapiens
gttgttgctacccgatatggtttggctgcgtccccacccaaatttcatcttgaattgtagttcccataatccccatgtgtcgtgggagggacccggtaggaggtaatcgaatcatgggggcaggtttttcccatactgttctcgtgatagtgaatacatctcactaaatctgatggttttataaagggcagtttccctgcacgtgctctcttgcctgctgccatggaagacatacctttttgctccttgccttccaccatgattctgaggcctctccagccttgtggaactgtgagtacattaaacctctttttctttataaattacccagtttccagtatttcttcatagcagtatgaaaagtaactaatacactacccgagacatcttaggagatttgtaatagctgtaatgccaggtccaccatatttttagcataaagcaaatgtttacgcgtgatatgactgcacgggctttctttcagctggagccatagcaactcaagtagtaaccctatcttagtctgattaaaagtaaatattagtctgggcatggtgggacatgcctgtaatcccagtactttggaatgtccttgctcaacaggaagggtccattcagtcggatcgggtggcttccaattttatttttggtttacatctcaactatcacagcagccgggcgcggtggcttcacagctgtaatcccagcactttgggaggttgaggagggcagatcacaaggtcaggaga

SEQ ID NO: 345284 - DNA, 3388 bp, Homo sapiens
aacgtgggggcgaaacaacacggccgggaggcggccgctgcctgccgggccctctcttctgggaccctggattttcggacactgagcgccatggccctgcctctgctgccgggcaacagcttcaaccgcaacgttaaaggagatggaagtgatgtaccatcatgggtagcctttgataaacaggtattatcttttgatgcctatttggaagaggaagtacttgataaaagccaaaccaactacagaataagatactataaaatctacttctaccctgaagatgacacaattcaagtaaatgaaccagaggtgaaaaatagtggattacttcaagggacttctatccggcgtcatcggattactcttccgcctcctgatgaggatcagttttatactgtgtatcattttaatgtcggcacagaggttgtcttctatggccggacattcaagatttatgactgtgatgcattcacaagaaactttttgaggaaaataggggtcaaagtgaatcccccagtgcaatgtccagaagatccttacatgaagattcggagagaggttgtagaacacgtagagcccttacgtccctacgaatccctcgacaccctgaaacagttcctccagtatcatggcaagattttgtgtttcttctgcctgtgggatgactcagtctcaatgtttggagaccgtagagaactcatcctgcattacttcttgtgtgatgatactattgaaatcaaagaattgcttccacacagctcaggccgagatgctctaaaaatgttcctccggaggagtaagctacccaagaattgcccacctagagtctatcaaccaggccagataacagatcgagcagttctcaattcatatggtgactttataaagaaccaagcggatggctacctgttcgatagatataagctaggaaaagtagaccaagagttttacaaagatagtgacctgtccctaggagtcaccatcaatgtgtggggaagaaaagtgctcctttatgactgtgatgaatttacgaagtcttattataagtctaaatatggaattgagaactttacctcagtttcatgcaagcctccttctcctcctccaaaaatagaaaggaaatttccaccttacaacggttttggttctgaagaggattctctccgtaactgcatagacctcaagcccacacctcatcggaggaacttcaagaagtttatggaaaaagacagctatggctccaaaagcaatatactccgttttttttgcaaaactagtcacagacaaatgtgttgacttggacaggatgtttgttatttcatattatctcggtgatgacaccatttcagtgtttgaacctatagagaggaattcaggaattgctggtgggatgttcttgaaaagaagtcgcgttaagaagcctggacaagaagtctttaaaagtgaactatctgaatatatcaaggccgaggagctgtacattggagtcacggtgaatgtgaatggttacctatttcgtttgctcaatgctgatgagtataccttaaactacatggagcagaatacagataagtatcctttcagtaacctcaaacttgccctacaaaagctgaagcaagaagaaggaaaatccagagagctcaagcaggtatttaaagctgctgactctaagcacacaaatatggtggattataatacattcagagacatattgatgtctttgactgttggaaaccttgcagagcaagaatttgtaaccattgcacgtcactaccgtgtgcctgagggcacatgttcagatatggatttcttaatcgcactggcccacgaaaagttcaagaaaaatatgtttgagaatttcgacactttcatttattcctgtgtgtatgaagatcgagaaaaaaaaaatgtattacccaccaaagacattaaaaggctgtgcaaatcctccagattacctttgagtgatgatcttctagaatccttattgtcaaggtttgaagacagtgaaaaacaaatagattataagtcatttttctctgccctgaactggagaaagaatccagtgcctgaattgcaaccagcatcataccttaaagagagatgtgaagatgtttggcttggtatgccatcacctattcctgcgaaatacattgactactggacctttttgaaggacgcgtttggcttagaggaggaataaccatgccagttttggtcaattctctatgatttacttctctcattttgccacatttactttagtagatataatttcattaaaaacaaaaaagaaacaaggtttatattaaatggaaatccataaaccacaattaatcctattttgtcatgttagttttacagaacatcatgttacattgccgacgtactgttactatttaaaatgccatcttaaaacatgttgaatatttttattatatgtatggtttattaataccaaaaaatcttctgataatttttgatccaacataatttgattcattactatatgaacagaaaatgacttttgaaggttatacatgacaatacaaaatcaaattatatcacagcaataagttgtgattctattaaacatttttgaaacctttttgacacgtttattacttacataattaagttttgtagcaacccacctcatcaaaataattcttaaacctctctagagtaaatatatttatcttttgaacttagtaaagctatgggaagaaaaagaacctccaacacacacacacacacacacacacacgcacgtgcacacacactggaaacatatgcagtatttatatttgtaatgcccttttttctatctaaagtcagcttgttagcctaggaatatatgcatgtgtgtataattatagtttgaccaaaactttattatgtctaaaatatttacaaatgtgaaagctgaagattttgagatttttgttttttttttggtttgttttacacacacatcccacgcgccccaccctagaggtttaaatattcagaaactacaacatttttcccctgcatttttctagttctatttttatttttcttcagcagaactcttgtcatgtagtgtacatttgattaaaacccatagccatgtacctctgggaattcagtgtaagaagtctatcccagtctatgccattgttcagtgttggatgctatgtatcataaatccatttgcctggtgttctgggagacaatggaggtctcaaaaaggagctgcaccatttacctttcagggactaccctgagaaaaagaagagctgatgacatctcaagggacccttcggactcattattctttcactccacatttgcagcagtgtcttgctggcttcttggcactcaaatgtaccaatttattctccac

SEQ ID NO: 345285 - DNA, 2596 bp, Homo sapiens
tttgattttgtcttccagaattgcccacctagagtctatcaaccaggccagataacagatcgagcagttctcaattcatatggtgactttataaagaaccaagcggatggctacctgttcgatagatataagctaggaaaagtagaccaagagttttacaaagatagtgacctgtccctaggagtcaccatcaatgtgtggggaagaaaagtgctcctttatgactgtgatgaatttacgaagtcttattataagtctaaatatggaattgagaactttacctcagtttcatgcaagcctccttctcctcctccaaaaatagaaaggaaatttccaccttacaacggttttggttctgaagaggattctctccgtaactgcatagacctcaagcccacacctcatcggaggaacttcaagaagtttatggaaaaagacagctatggctccaaaagcaatatactccgttttttttgcaaaactagtcacagacaaatgtgttgacttggacaggatgtttgttatttcatattatctcggtgatgacaccatttcagtgtttgaacctatagagaggaattcaggaattgctggtgggatgttcttgaaaagaagtcgcgttaagaagcctggacaagaagtctttaaaagtgaactatctgaatatatcaaggccgaggagctgtacattggagtcacggtgaatgtgaatggttacctatttcgtttgctcaatgctgatgagtataccttaaactacatggagcagaatacagataagtatcctttcagtaacctcaaacttgccctacaaaagctgaagcaagaagaaggaaaatccagagagctcaagcaggtatttaaagctgctgactctaagcacacaaatatggtggattataatacattcagagacatattgatgtctttgactgttggaaaccttgcagagcaagaatttgtaaccattgcacgtcactaccgtgtgcctgagggcacatgttcagatatggatttcttaatcgcactggcccacgaaaagttcaagaaaaatatgtttgagaatttcgacactttcatttattcctgtgtgtatgaagatcgagaaaaaaaaaatgtattacccaccaaagacattaaaaggctgtgcaaatcctccagattacctttgagtgatgatcttctagaatccttattgtcaaggtttgaagacagtgaaaaacaaatagattataagtcatttttctctgccctgaactggagaaagaatccagtgcctgaattgcaaccagcatcataccttaaagagagatgtgaagatgtttggcttggtatgccatcacctattcctgcgaaatacattgactactggacctttttgaaggacgcgtttggcttagaggaggaataaccatgccagttttggtcaattctctatgatttacttctctcattttgccacatttactttagtagatataatttcattaaaaacaaaaaagaaacaaggtttatattaaatggaaatccataaaccacaattaatcctattttgtcatgttagttttacagaacatcatgttacattgccgacgtactgttactatttaaaatgccatcttaaaacatgttgaatatttttattatatgtatggtttattaataccaaaaaatcttctgataatttttgatccaacataatttgattcattactatatgaacagaaaatgacttttgaaggttatacatgacaatacaaaatcaaattatatcacagcaataagttgtgattctattaaacatttttgaaacctttttgacacgtttattacttacataattaagttttgtagcaacccacctcatcaaaataattcttaaacctctctagagtaaatatatttatcttttgaacttagtaaagctatgggaagaaaaagaacctccaacacacacacacacacacacacacacgcacgtgcacacacactggaaacatatgcagtatttatatttgtaatgcccttttttctatctaaagtcagcttgttagcctaggaatatatgcatgtgtgtataattatagtttgaccaaaactttattatgtctaaaatatttacaaatgtgaaagctgaagattttgagatttttgttttttttttggtttgttttacacacacatcccacgcgccccaccctagaggtttaaatattcagaaactacaacatttttcccctgcatttttctagttctatttttatttttcttcagcagaactcttgtcatgtagtgtacatttgattaaaacccatagccatgtacctctgggaattcagtgtaagaagtctatcccagtctatgccattgttcagtgttggatgctatgtatcataaatccatttgcctggtgttctgggagacaatggaggtctcaaaaaggagctgcaccatttacctttcagggactaccctgagaaaaagaagagctgatgacatctcaagggacccttcggactcattattctttcactccacatttgcagcagtgtcttgctggcttcttggcactcaaatgtaccaatttattctccac

SEQ ID NO: 345286 - DNA, 1526 bp, Homo sapiens
ggaaaaaaaaaaaaaaaaaaaaaaaaaaaaaaaaaaaaaaaaaatctcactcatttgttcatatattggtctctgaggtcccttctaggctctgacaactggaaactctgaaaatagacatattgatgtctttgactgttggaaaccttgcagagcaagaatttgtaaccattgcacgtcactaccgtgtgcctgagggcacatgttcagatatggatttcttaatcgcactggcccacgaaaagttcaagaaaaatatgtttgagaatttcgacactttcatttattcctgtgtgtatgaagatcgagaaaaaaaaaatgtattacccaccaaagacattaaaaggctgtgcaaatcctccagattacctttgagtgatgatcttctagaatccttattgtcaaggtttgaagacagtgaaaaacaaatagattataagtcatttttctctgccctgaactggagaaagaatccagtgcctgaattgcaaccagcatcataccttaaagagagatgtgaagatgtttggcttggtatgccatcacctattcctgcgaaatacattgactactggacctttttgaaggacgcgtttggcttagaggaggaataaccatgccagttttggtcaattctctatgatttacttctctcattttgccacatttactttagtagatataatttcattaaaaacaaaaaagaaacaaggtttatattaaatggaaatccataaaccacaattaatcctattttgtcatgttagttttacagaacatcatgttacattgccgacgtactgttactatttaaaatgccatcttaaaacatgttgaatatttttattatatgtatggtttattaataccaaaaaatcttctgataatttttgatccaacataatttgattcattactatatgaacagaaaatgacttttgaaggttatacatgacaatacaaaatcaaattatatcacagcaataagttgtgattctattaaacatttttgaaacctttttgacacgtttattacttacataattaagttttgtagcaacccacctcatcaaaataattcttaaacctctctagagtaaatatatttatcttttgaacttagtaaagctatgggaagaaaaagaacctccaacacacacacacacacacacacacacgcacgtgcacacacactggaaacatatgcagtatttatatttgtaatgcccttttttctatctaaagtcagcttgttagcctaggaatatatgcatgtgtgtataattatagtttgaccaaaactttattatgtctaaaatatttacaaatgtgaaagctgaagattttgagatttttgttttttttttggtttgttttacacacacatcccacgcgccccaccctagaggtttaaatattcagaaactacaacatttttcccctgcatttttctagttctatttttatttttcttcagcagaactcttgtcatgtagtgtacatttgattaaaacccatagccatgt

SEQ ID NO: 345287 - DNA, 3528 bp, Homo sapiens
aacgtgggggcgaaacaacacggccgggaggcggccgctgcctgccgggccctctcttctgggaccctggattttcggacactgagcgccatggccctgcctctgctgccgggcaacagcttcaaccgcaacgtgtgggaaaggagaagtttcacaaatcccaacattggggcttttgcaacaatgttatgatgttggtgagtgatgaaaagcctggaataggtggagaaccacttctggggcaaaagataaagcctaaatgtagcatatatcctaaaggagatggaagtgatgtaccatcatgggtagcctttgataaacaggtattatcttttgatgcctatttggaagaggaagtacttgataaaagccaaaccaactacagaataagatactataaaatctacttctaccctgaagatgacacaattcaagtaaatgaaccagaggtgaaaaatagtggattacttcaagggacttctatccggcgtcatcggattactcttccgcctcctgatgaggatcagttttatactgtgtatcattttaatgtcggcacagaggttgtcttctatggccggacattcaagatttatgactgtgatgcattcacaagaaactttttgaggaaaataggggtcaaagtgaatcccccagtgcaatgtccagaagatccttacatgaagattcggagagaggttgtagaacacgtagagcccttacgtccctacgaatccctcgacaccctgaaacagttcctccagtatcatggcaagattttgtgtttcttctgcctgtgggatgactcagtctcaatgtttggagaccgtagagaactcatcctgcattacttcttgtgtgatgatactattgaaatcaaagaattgcttccacacagctcaggccgagatgctctaaaaatgttcctccggaggagtaagctacccaagaattgcccacctagagtctatcaaccaggccagataacagatcgagcagttctcaattcatatggtgactttataaagaaccaagcggatggctacctgttcgatagatataagctaggaaaagtagaccaagagttttacaaagatagtgacctgtccctaggagtcaccatcaatgtgtggggaagaaaagtgctcctttatgactgtgatgaatttacgaagtcttattataagtctaaatatggaattgagaactttacctcagtttcatgcaagcctccttctcctcctccaaaaatagaaaggaaatttccaccttacaacggttttggttctgaagaggattctctccgtaactgcatagacctcaagcccacacctcatcggaggaacttcaagaagtttatggaaaaagacagctatggctccaaaagcaatatactccgttttttttgcaaaactagtcacagacaaatgtgttgacttggacaggatgtttgttatttcatattatctcggtgatgacaccatttcagtgtttgaacctatagagaggaattcaggaattgctggtgggatgttcttgaaaagaagtcgcgttaagaagcctggacaagaagtctttaaaagtgaactatctgaatatatcaaggccgaggagctgtacattggagtcacggtgaatgtgaatggttacctatttcgtttgctcaatgctgatgagtataccttaaactacatggagcagaatacagataagtatcctttcagtaacctcaaacttgccctacaaaagctgaagcaagaagaaggaaaatccagagagctcaagcaggtatttaaagctgctgactctaagcacacaaatatggtggattataatacattcagagacatattgatgtctttgactgttggaaaccttgcagagcaagaatttgtaaccattgcacgtcactaccgtgtgcctgagggcacatgttcagatatggatttcttaatcgcactggcccacgaaaagttcaagaaaaatatgtttgagaatttcgacactttcatttattcctgtgtgtatgaagatcgagaaaaaaaaaatgtattacccaccaaagacattaaaaggctgtgcaaatcctccagattacctttgagtgatgatcttctagaatccttattgtcaaggtttgaagacagtgaaaaacaaatagattataagtcatttttctctgccctgaactggagaaagaatccagtgcctgaattgcaaccagcatcataccttaaagagagatgtgaagatgtttggcttggtatgccatcacctattcctgcgaaatacattgactactggacctttttgaaggacgcgtttggcttagaggaggaataaccatgccagttttggtcaattctctatgatttacttctctcattttgccacatttactttagtagatataatttcattaaaaacaaaaaagaaacaaggtttatattaaatggaaatccataaaccacaattaatcctattttgtcatgttagttttacagaacatcatgttacattgccgacgtactgttactatttaaaatgccatcttaaaacatgttgaatatttttattatatgtatggtttattaataccaaaaaatcttctgataatttttgatccaacataatttgattcattactatatgaacagaaaatgacttttgaaggttatacatgacaatacaaaatcaaattatatcacagcaataagttgtgattctattaaacatttttgaaacctttttgacacgtttattacttacataattaagttttgtagcaacccacctcatcaaaataattcttaaacctctctagagtaaatatatttatcttttgaacttagtaaagctatgggaagaaaaagaacctccaacacacacacacacacacacacacacgcacgtgcacacacactggaaacatatgcagtatttatatttgtaatgcccttttttctatctaaagtcagcttgttagcctaggaatatatgcatgtgtgtataattatagtttgaccaaaactttattatgtctaaaatatttacaaatgtgaaagctgaagattttgagatttttgttttttttttggtttgttttacacacacatcccacgcgccccaccctagaggtttaaatattcagaaactacaacatttttcccctgcatttttctagttctatttttatttttcttcagcagaactcttgtcatgtagtgtacatttgattaaaacccatagccatgtacctctgggaattcagtgtaagaagtctatcccagtctatgccattgttcagtgttggatgctatgtatcataaatccatttgcctggtgttctgggagacaatggaggtctcaaaaaggagctgcaccatttacctttcagggactaccctgagaaaaagaagagctgatgacatctcaagggacccttcggactcattattctttcactccacatttgcagcagtgtcttgctggcttcttggcactcaaatgtaccaatttattctccac

SEQ ID NO: 345288 - DNA, 393 bp, Homo sapiens
caattcatattcccagcatcaatgactaagaaggctgggtcaaattagataggtgaaaggcaaatcctcttttcatttatcccttgatggtttgcattttctcttatgaagagaaatctcttgttggattatcagtttttagaagatcttttattttggtgaaattcactttctgcttgtcatatgtgatgcaatattttcttcttccttatctttggcataatttataactttttaacattacaaaattttgtatgtgatcaaacaagtcactcttttcattattggatctgggttttctgtgtggtctaaaaagtcctgctttgtcaaagttaggcaactaactattcaattagatttttttgtttgtttgtttgagacagagtctcactc

SEQ ID NO: 345289 - DNA, 81 bp, Homo sapiens
tttttttttttcttgcccagttgttctgactagaacctttagtactatcttgaatagggaagtggtgaaagtgggcgtcct

SEQ ID NO: 345290 - DNA, 403 bp, Homo sapiens
gttttgcattttcccttctgttttctgattagagtctctatggcttatgagtgcagagagaacctcaaaagatcatgtttgctgcggataagcaccaaactcgatgtttatcagcacttatctcctgcaaactcactctctggaggcttcaaaggctgagggagatctcttagccttgctctgaggagacaggcaggcactcctccccggggcttcagctgcaggtgtggcccaatagcacttgccccattcttaggaacgtggttctcttgctcttccccatgcaaaaaaaggaagcagcaggtttactgaaggtatggggatgagctgtggggtagagggagcaggagaagaaaacaagtattttaaaacaagcccggaaaggctgagaaagtaggtagag

SEQ ID NO: 345291 - DNA, 3663 bp, Homo sapiens
ataattgagggaaatagtgcttgtgggtttcctgtgtcgtgtgttttccccctttctttttggtgactcccttgtgttatttttttggctttgttgagttttcgtccagccgtacacaatatggagagtccccaatgccccttgttaagtgccggctaccctcttcgttaccttaacgtccgacagcctaccgtcagtttaattcataaagttactgtaactcttgacatcacctccgcagcccacccgaggactccttcccaggacaccttatgaggctgttttccgagggctgaattctgagacttaaaggaaggttacttgaggcatcctggtatatttccgggcttccaactccctcccctgcttggctggtaattttctgctgctcctcctcctcccccacttgacctcctccgaggtaccttcgcctcccctcccccgctcgtccccagtaaatctccagcgggtgggggaaatcaatcctttggcgctaaagctaaactcagagctgcccgttggacaggattgcagtggggtaaatggtgtccgtcctttcagaaagaatgatcaactacatggaggtaacttgctctgggtttcctgagatctcgggcggacccgtccgtgttttgccagattcagtgcaaatgtagatttcagctgaaccggtcaggacttgagagatagctgtttcactctccggactgcaaccacttccgcgagaatctgatacatttaatgaaagctttgccaaatgtacgggtcagcgcgtccttgggccaccaccacttgggtcagcacactgcactcactagcgccaacctgggctccacgcagcagaactcggttaaaaatcgtctgttcctggtcacttaggagttcagccactcgccaccggcggcagaaagtgagccccgcgcgcaacgcgggaggggacagaaggaagaggaagaggaggagagggaggccagagccagaacagcccggcagcccgagcttcgggggagaacggcctgagccccgagcaagttgcctcgggagccctaatcctctcccgctggctcgccgagcggtcagtggcgctcagcggcggcgaggctgaaatatgataatcagaacagctgcgccgcgcgccctgcagccaatgggcgcggcgctcgcctgacgtccccgcgcgctgcgtcagaccaatggcgatggagctgagttggagcagagaagtttgagtaagagataaggaagagaggtgcccgagccgcgccgagtctgccgccgccgcagcgcctccgctccgccaactccgccggcttaaattggactcctagatccgcgagggcgcggcgcagccgagcagcggctctttcagcattggcaaccccaggggccaatatttcccacttagccacagctccagcatcctctctgtgggctgttcaccaactgtacaaccaccatttcactgtggacattactccctcttacagatatgggagacatgggagatccaccaaaaaaaaaacgtctgatttccctatgtgttggttgcggcaatcagattcacgatcagtatattctgagggtttctccggatttggaatggcatgcggcatgtttgaaatgtgcggagtgtaatcagtatttggacgagagctgtacatgctttgttagggatgggaaaacctactgtaaaagagattatatcaggttgtacgggatcaaatgcgccaagtgcagcatcggcttcagcaagaacgacttcgtgatgcgtgcccgctccaaggtgtatcacatcgagtgtttccgctgtgtggcctgcagccgccagctcatccctggggacgaatttgcgcttcgggaggacggtctcttctgccgagcagaccacgatgtggtggagagggccagtctaggcgctggcgacccgctcagtcccctgcatccagcgcggccactgcaaatggcagcggagcccatctccgccaggcagccagccctgcggccccacgtccacaagcagccggagaagaccacccgcgtgcggactgtgctgaacgagaagcagctgcacaccttgcggacctgctacgccgcaaacccgcggccagatgcgctcatgaaggagcaactggtagagatgacgggcctcagtccccgtgtgatccgggtctggtttcaaaacaagcggtgcaaggacaagaagcgaagcatcatgatgaagcaactccagcagcagcagcccaatgacaaaactaatatccaggggatgacaggaactcccatggtggctgccagtccagagagacacgacggtggcttacaggctaacccagtggaagtacaaagttaccagccaccttggaaagtactgagcgacttcgccttgcagagtgacatagatcagcctgcttttcagcaactggtcaatttttcagaaggaggaccgggctctaattccactggcagtgaagtagcatcaatgtcctctcaacttccagatacacctaacagcatggtagccagtcctattgaggcatgaggaacattcattctgtattttttttccctgttggagaaagtgggaaattataatgtcgaactctgaaacaaaagtatttaacgacccagtcaatgaaaactgaatcaagaaatgaatgctccatgaaatgcacgaagtctgttttaatgacaaggtgatatggtagcaacactgtgaagacaatcatgggattttactagaattaaacaacaaacaaaacgcaaaacccagtatatgctattcaatgatcttagaagtactgaaaaaaaaagacgtttttaaaacgtagaggatttatattcaaggatctcaaagaaagcattttcatttcactgcacatctagagaaaaacaaaaatagaaaattttctagtccatcctaatctgaatggtgctgtttctatattggtcattgccttgccaaacaggagctccagcaaaagcgcaggaagagagactggcctccttggctgaaagagtcctttcaggaaggtggagctgcattggtttgatatgtttaaagttgactttaacaaggggttaattgaaatcctgggtctcttggcctgtcctgtagctggtttattttttactttgccccctccccactttttttgagatccatcctttatcaagaagtctgaagcgactataaaggtttttgaattcagatttaaaaaccaacttataaagcattgcaacaaggttacctctattttgccacaagcgtctcgggattgtgtttgacttgtgtctgtccaagaacttttcccccaaagatgtgtatagttattggttaaaatgactgttttctctctctatggaaataaaaaggaaaaaaaaaaaggaaactttttttgtttgctcttgcattgcaaaaattataaagtaatttattatttattgtcggaagacttgccacttttcatgtcatttgacattttttgtttgctgaagtgaaaaaaaaagataaaggttgtacggtggtctttgaattatatgtctaattctatgtgttttgtctttttcttaaatattatgtgaaatcaaagcgccatatgtagaattatatcttcaggactatttcactaataaacatttggcatagataaataaataaaaaca

SEQ ID NO: 345292 - DNA, 3756 bp, Homo sapiens
ataattgagggaaatagtgcttgtgggtttcctgtgtcgtgtgttttccccctttctttttggtgactcccttgtgttatttttttggctttgttgagttttcgtccagccgtacacaatatggagagtccccaatgccccttgttaagtgccggctaccctcttcgttaccttaacgtccgacagcctaccgtcagtttaattcataaagttactgtaactcttgacatcacctccgcagcccacccgaggactccttcccaggacaccttatgaggctgttttccgagggctgaattctgagacttaaaggaaggttacttgaggcatcctggtatatttccgggcttccaactccctcccctgcttggctggtaattttctgctgctcctcctcctcccccacttgacctcctccgaggtaccttcgcctcccctcccccgctcgtccccagtaaatctccagcgggtgggggaaatcaatcctttggcgctaaagctaaactcagagctgcccgttggacaggattgcagtggggtaaatggtgtccgtcctttcagaaagaatgatcaactacatggaggtaacttgctctgggtttcctgagatctcgggcggacccgtccgtgttttgccagattcagtgcaaatgtagatttcagctgaaccggtcaggacttgagagatagctgtttcactctccggactgcaaccacttccgcgagaatctgatacatttaatgaaagctttgccaaatgtacgggtcagcgcgtccttgggccaccaccacttgggtcagcacactgcactcactagcgccaacctgggctccacgcagcagaactcggttaaaaatcgtctgttcctggtcacttaggagttcagccactcgccaccggcggcagaaagtgagccccgcgcgcaacgcggccagccggactgcggggaccccaggagcgcagggcggaggagcagcgccacaggaggcgagggcgcaggcggcgcggccgggaaggaacgcgggaggggacagaaggaagaggaagaggaggagagggaggccagagccagaacagcccggcagcccgagcttcgggggagaacggcctgagccccgagcaagttgcctcgggagccctaatcctctcccgctggctcgccgagcggtcagtggcgctcagcggcggcgaggctgaaatatgataatcagaacagctgcgccgcgcgccctgcagccaatgggcgcggcgctcgcctgacgtccccgcgcgctgcgtcagaccaatggcgatggagctgagttggagcagagaagtttgagtaagagataaggaagagaggtgcccgagccgcgccgagtctgccgccgccgcagcgcctccgctccgccaactccgccggcttaaattggactcctagatccgcgagggcgcggcgcagccgagcagcggctctttcagcattggcaaccccaggggccaatatttcccacttagccacagctccagcatcctctctgtgggctgttcaccaactgtacaaccaccatttcactgtggacattactccctcttacagatatgggagacatgggagatccaccaaaaaaaaaacgtctgatttccctatgtgttggttgcggcaatcagattcacgatcagtatattctgagggtttctccggatttggaatggcatgcggcatgtttgaaatgtgcggagtgtaatcagtatttggacgagagctgtacatgctttgttagggatgggaaaacctactgtaaaagagattatatcaggttgtacgggatcaaatgcgccaagtgcagcatcggcttcagcaagaacgacttcgtgatgcgtgcccgctccaaggtgtatcacatcgagtgtttccgctgtgtggcctgcagccgccagctcatccctggggacgaatttgcgcttcgggaggacggtctcttctgccgagcagaccacgatgtggtggagagggccagtctaggcgctggcgacccgctcagtcccctgcatccagcgcggccactgcaaatggcagcggagcccatctccgccaggcagccagccctgcggccccacgtccacaagcagccggagaagaccacccgcgtgcggactgtgctgaacgagaagcagctgcacaccttgcggacctgctacgccgcaaacccgcggccagatgcgctcatgaaggagcaactggtagagatgacgggcctcagtccccgtgtgatccgggtctggtttcaaaacaagcggtgcaaggacaagaagcgaagcatcatgatgaagcaactccagcagcagcagcccaatgacaaaactaatatccaggggatgacaggaactcccatggtggctgccagtccagagagacacgacggtggcttacaggctaacccagtggaagtacaaagttaccagccaccttggaaagtactgagcgacttcgccttgcagagtgacatagatcagcctgcttttcagcaactggtcaatttttcagaaggaggaccgggctctaattccactggcagtgaagtagcatcaatgtcctctcaacttccagatacacctaacagcatggtagccagtcctattgaggcatgaggaacattcattctgtattttttttccctgttggagaaagtgggaaattataatgtcgaactctgaaacaaaagtatttaacgacccagtcaatgaaaactgaatcaagaaatgaatgctccatgaaatgcacgaagtctgttttaatgacaaggtgatatggtagcaacactgtgaagacaatcatgggattttactagaattaaacaacaaacaaaacgcaaaacccagtatatgctattcaatgatcttagaagtactgaaaaaaaaagacgtttttaaaacgtagaggatttatattcaaggatctcaaagaaagcattttcatttcactgcacatctagagaaaaacaaaaatagaaaattttctagtccatcctaatctgaatggtgctgtttctatattggtcattgccttgccaaacaggagctccagcaaaagcgcaggaagagagactggcctccttggctgaaagagtcctttcaggaaggtggagctgcattggtttgatatgtttaaagttgactttaacaaggggttaattgaaatcctgggtctcttggcctgtcctgtagctggtttattttttactttgccccctccccactttttttgagatccatcctttatcaagaagtctgaagcgactataaaggtttttgaattcagatttaaaaaccaacttataaagcattgcaacaaggttacctctattttgccacaagcgtctcgggattgtgtttgacttgtgtctgtccaagaacttttcccccaaagatgtgtatagttattggttaaaatgactgttttctctctctatggaaataaaaaggaaaaaaaaaaaggaaactttttttgtttgctcttgcattgcaaaaattataaagtaatttattatttattgtcggaagacttgccacttttcatgtcatttgacattttttgtttgctgaagtgaaaaaaaaagataaaggttgtacggtggtctttgaattatatgtctaattctatgtgttttgtctttttcttaaatattatgtgaaatcaaagcgccatatgtagaattatatcttcaggactatttcactaataaacatttggcatagataaataaataaaaaca

SEQ ID NO: 345293 - DNA, 219 bp, Homo sapiens
ggctgataccatctcgacaagtgtgcagagtgagatagacagcctgttttcagcaactggtcaatttttcagaaggaggaccgggctctaattccactggcagtgaagtagcatcaatgtcctctcaacttccagatacacggggcaaaaggtcagactggatttcaaacccaaataaactgccagtcccttctgggcaaagcagagccattctcccta

SEQ ID NO: 345294 - DNA, 2379 bp, Homo sapiens
ggtgtgtaaacgcaagattctagagaaggagagcccacttcaggagtatctttactgctatggaaatagtattttgctcaattgcacacaggcttgcatgtgcctaattctggatacacacatgtgtagaaggaactaatcatttttaccttctcttcactctctctcaactctgtgtgtgtgtgtgtgtgtgtgtgtgtgtgtgtgtgtaatcttgtagttgtaaaagcagaacagactggacagttagatttccacatctctccttggagaagcaggatgcctcctcctgttatgtggatcttttcctctctcttccattctttctgttcgtaggaatgccccagcttctgttattcctgaaagatggagaaggggccagggaagtgcagcctagatggaacctataaagattgtcccttggttgtacgggatcaaatgcgccaagtgcagcatcggcttcagcaagaacgacttcgtgatgcgtgcccgctccaaggtgtatcacatcgagtgtttccgctgtgtggcctgcagccgccagctcatccctggggacgaatttgcgcttcgggaggacggtctcttctgccgagcagaccacgatgtggtggagagggccagtctaggcgctggcgacccgctcagtcccctgcatccagcgcggccactgcaaatggcagcggagcccatctccgccaggcagccagccctgcggccccacgtccacaagcagccggagaagaccacccgcgtgcggactgtgctgaacgagaagcagctgcacaccttgcggacctgctacgccgcaaacccgcggccagatgcgctcatgaaggagcaactggtagagatgacgggcctcagtccccgtgtgatccgggtctggtttcaaaacaagcggtgcaaggacaagaagcgaagcatcatgatgaagcaactccagcagcagcagcccaatgacaaaactaatatccaggggatgacaggaactcccatggtggctgccagtccagagagacacgacggtggcttacaggctaacccagtggaagtacaaagttaccagccaccttggaaagtactgagcgacttcgccttgcagagtgacatagatcagcctgcttttcagcaactggtcaatttttcagaaggaggaccgggctctaattccactggcagtgaagtagcatcaatgtcctctcaacttccagatacacctaacagcatggtagccagtcctattgaggcatgaggaacattcattctgtattttttttccctgttggagaaagtgggaaattataatgtcgaactctgaaacaaaagtatttaacgacccagtcaatgaaaactgaatcaagaaatgaatgctccatgaaatgcacgaagtctgttttaatgacaaggtgatatggtagcaacactgtgaagacaatcatgggattttactagaattaaacaacaaacaaaacgcaaaacccagtatatgctattcaatgatcttagaagtactgaaaaaaaaagacgtttttaaaacgtagaggatttatattcaaggatctcaaagaaagcattttcatttcactgcacatctagagaaaaacaaaaatagaaaattttctagtccatcctaatctgaatggtgctgtttctatattggtcattgccttgccaaacaggagctccagcaaaagcgcaggaagagagactggcctccttggctgaaagagtcctttcaggaaggtggagctgcattggtttgatatgtttaaagttgactttaacaaggggttaattgaaatcctgggtctcttggcctgtcctgtagctggtttattttttactttgccccctccccactttttttgagatccatcctttatcaagaagtctgaagcgactataaaggtttttgaattcagatttaaaaaccaacttataaagcattgcaacaaggttacctctattttgccacaagcgtctcgggattgtgtttgacttgtgtctgtccaagaacttttcccccaaagatgtgtatagttattggttaaaatgactgttttctctctctatggaaataaaaaggaaaaaaaaaaaggaaactttttttgtttgctcttgcattgcaaaaattataaagtaatttattatttattgtcggaagacttgccacttttcatgtcatttgacattttttgtttgctgaagtgaaaaaaaaagataaaggttgtacggtggtctttgaattatatgtctaattctatgtgttttgtctttttcttaaatattatgtgaaatcaaagcgccatatgtagaattatatcttcaggactatttcactaataaacatttggcatagataaataaataaaaaca

SEQ ID NO: 345295 - DNA, 299 bp, Homo sapiens
ggatcagagacatgcaccaccaaacccagctattttttgtattttcagtagagatgaggtttcaccatactggccaggctgtgtcgaactcctgacctcaggtgatctgcccgcctcggcctcccagagtgctgggattacaggcgtgagccaccgtgcccggcctaccatcatcttttatgtgaactactctactctccaagctgggcctgctgcttccagtcttgcccccctacagtttattttctgccagcagccagaattgtcttctgaaacatctatcagctgctgcttcctag

SEQ ID NO: 345296 - DNA, 518 bp, Homo sapiens
  misc_feature (477)..(478): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (492)..(492): n is a, c, g, or t
  misc_feature (495)..(495): n is a, c, g, or t
  misc_feature (499)..(499): n is a, c, g, or t
cgccccgggtggcctccgcccggaagacggaagtgcaaagacttccggtcggcgtgagcgtgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctgaaggcaaagcgagagaaaagaaaaaaaaaaaaaaaaaaaattgtggggggggccggggccccggaaaagnntnttntaaganccnttncggngggggcgcgcgggggcccc

SEQ ID NO: 345297 - DNA, 1472 bp, Homo sapiens
ccacttggggcagtggaatccaaagaaacatggggaaaaaatttgaaaaccgcaatcaatcccatggggcatttccaaggttttaaaagtctacaggcaaacccttggccgcttcactgctttgcttggctttccccttttcttttctctcgctttgcatcagccttttcttttgccttgggttcatccaaaatgggtactgtcccatgcttggtctagaagagtcctttttgtttctcgttaaagacaagtctccattttcaagcatctgttttcatctttttacctcacagtgcattttctcttgggcaatgttggggtttgggataccaccacagttgctatctctttgaacatctttcattaaaacatcacccgtctagtttgagaatacttttaagcctgctggcctcctttggggcattcttttttctcttttcagcacgcatctttcttttccgcttactccgtaagcttttagccatgttttacctgagaaacgaacacccacacctcacgctcacgccgaccagcatggacagtacccaatatggatgaaccaaaggcaaagaaaaaggctgaaggcaaagcgagagaaaagaaaggggaaaagcaaagcaaaagcagtgaaagtggcaaagggtttggcctggtagactcttaaaaccttggaaaatgccacatgggatagatgacggattagaatgtatacacatgtatactttgatttcaactgccaccaaatgaaaaccatttgttttcctattttaacttggccttttttcttcaattcaaacccagcataactcctcaagtttgttttgggaacttgaataaaatattttctttgatacatccaagctctactgatactttaactggatgctacccaatatccagttataatcaggcctcaacgttctgtcaggtattaatatggttagaattgttcttacaactggtaattatagtcaatagagataaaacagatgatgtactgacaaatttttgtgaacttagattttaaagaaagttgttgtataatcatatcatttaaaaatactacattagggctgggcatggtggctcacacctgtaatcccagcactttgggaggccgaggcaggtggatcacgaggtcagttcgagactagcctggctaatacagtgaaaccccatctctactaaaaatacaaaattagccgggcatgggggcgcgcacctgtagttccagctactcgggaggctgaggcaggataattgcttgaacccaggagatggaggttgcagtgagccaagattgccccactgcactccaccctgggcaatggagtaggactctgtctcaaaaaaaaaaaaaataatggatcttataaagtacttgtgtggagctttgattccacagaataaaagatattggggtgttaaaaaaagagaaaaaagagaagagaagaatagaaaaagaaaaaaag

SEQ ID NO: 345298 - DNA, 1347 bp, Homo sapiens
cactgtgagccaccatgcccagcctcatcattcttattaactggtttaatcctttcaataatcctattaagtagaattattaggtaattagaattaggttaaaaagagctgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctgaaggcaaagcgagagaaaagaaaggggaaaagcaaagcaaaagcagtgaaagtggcaaagggtttggcctggtagactcttaaaaccttggaaaatgccacatgggatagatgacggattagaatgtatacacatgtatactttgatttcaactgccaccaaatgaaaaccatttgttttcctattttaacttggccttttttcttcaattcaaacccagcataactcctcaagtttgttttgggaacttgaataaaatattttctttgatacatccaagctctactgatactttaactggatgctacccaatatccagttataatcaggcctcaacgttctgtcaggtattaatatggttagaattgttcttacaactggtaattatagtcaatagagataaaacagatgatgtactgacaaatttttgtgaacttagattttaaagaaagttgttgtataatcatatcatttaaaaatactacattagggctgggcatggtggctcacacctgtaatcccagcactttgggaggccgaggcaggtggatcacgaggtcagttcgagactagcctggctaatacagtgaaaccccatctctactaaaaatacaaaattagccgggcatgggggcgcgcacctgtagttccagctactcgggaggctgaggcaggataattgcttgaacccaggagatggaggttgcagtgagccaagattgccccactgcactccaccctgggcaatggagtaggactctgtctcaaaaaaaaaaaaaataatggatcttataaagtacttgtgtggagctttgattccacagaataaaagatattggggtgttaaaaaaagagaaaaaagagaagagaagaatagaaaaagaaaaaaag

SEQ ID NO: 345299 - DNA, 1271 bp, Homo sapiens
cgccccgggtggcctccgcccggaagacggaagtgcaaagacttccggtcggcgtgagcgtgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctgaaggcaaagcgagagaaaagaaaggggaaaagcaaagcaaaagcagtgaaagtggcaaagggtttggcctggtagactcttaaaacctggattagaatgtatacacatgtatactttgatttcaactgccaccaaatgaaaaccatttgttttcctattttaacttggccttttttcttcaattcaaacccagcataactcctcaagtttgttttgggaacttgaataaaatattttctttgatacatccaagctctactgatactttaactggatgctacccaatatccagttataatcaggcctcaacgttctgtcaggtattaatatggttagaattgttcttacaactggtaattatagtcaatagagataaaacagatgatgtactgacaaatttttgtgaacttagattttaaagaaagttgttgtataatcatatcatttaaaaatactacattagggctgggcatggtggctcacacctgtaatcccagcactttgggaggccgaggcaggtggatcacgaggtcagttcgagactagcctggctaatacagtgaaaccccatctctactaaaaatacaaaattagccgggcatgggggcgcgcacctgtagttccagctactcgggaggctgaggcaggataattgcttgaacccaggagatggaggttgcagtgagccaagattgccccactgcactccaccctgggcaatggagtaggactctgtctcaaaaaaaaaaaaaataatggatcttataaagtacttgtgtggagctttgattccacagaataaaagatattggggtgttaaaaaaagagaaaaaagagaagagaagaatagaaaaagaaaaaaag

SEQ ID NO: 345300 - DNA, 714 bp, Homo sapiens
gacgtctacgaatccagctcgtaccccgttcttttattcccagcataactcctcaagtttgttttgggaacttgaataaaatattttctttgatacatccaagctctactgatactttaactggatgctacccaatatccagttataatcaggcctcaacgttctgtcaggtattaatatggttagaattgttcttacaactggtaattatagtcaatagagataaaacagatgatgtactgacaaatttttgtgaacttagattttaaagaaagttgttgtataatcatatcatttaaaaatactacattagggctgggcatggtggctcacacctgtaatcccagcactttgggaggccgaggcaggtggatcacgaggtcagttcgagactagcctggctaatacagtgaaaccccatctctactaaaaatacaaaattagccgggcatgggggcgcgcacctgtagttccagctactcgggaggctgaggcaggataattgcttgaacccaggagatggaggttgcagtgagccaagattgccccactgcactccaccctgggcaatggagtaggactctgtctcaaaaaaaaaaaaaataatggatcttataaagtacttgtgtggagctttgattccacagaataaaagatattggggtgttaaaaaaagagaaaaaagagaagagaagaatagaaaaagaaaaaaag

SEQ ID NO: 345301 - DNA, 1020 bp, Homo sapiens
cgccccgggtggcctccgcccggaagacggaagtgcaaagacttccggtcggcgtgagcgtgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctgaaggcaaagcgagagaaaagaaaggggaaaagcaaagcaaaagcagtgaaagtggcaaagggtttggcctggtagactcttaaaaccttggaaaatgccacatgggatagatgacggattagaatgtatacacatgtatactttgatttcaactgccaccaaatgaaaaccatttgttttcctattttaacttggccttttttcttcaattcaaacccagcataactcctcaagtttgttttgggaacttgaataaaatattttctttgatacatccaagctctactgatactttaactggatgctacccaatatccagttataatcaggcctcaacgttctgtcaggtattaatatggttagaattgttcttacaactggtaattatagtcaatagagataaaacagatgatgtactgacaaatttttgtgaacttagattttaaagaaagttgttgtataatcatatcatttaaaaatactacattagggctgggcatggtggctcacacctgtaatcccagcactttgggaggccgaggcaggtggatcacgaggtcagttcgagactagcctggctaatacagtgaaaccccatctctactaaaaatac

SEQ ID NO: 345302 - DNA, 1298 bp, Homo sapiens
cgccccgggtggcctccgcccggaagacggaagtgcaaagacttccggtcggcgtgagcgtgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctgaaggcaaagcgagagaaaagaaaggggaaaagcaaagcaaaagcagtgaaagtggcaaagggtttggcctggtagactcttaaaaccttggaaaatgccacatgggatagatgacggattagaatgtatacacatgtatactttgatttcaactgccaccaaatgaaaaccatttgttttcctattttaacttggccttttttcttcaattcaaacccagcataactcctcaagtttgttttgggaacttgaataaaatattttctttgatacatccaagctctactgatactttaactggatgctacccaatatccagttataatcaggcctcaacgttctgtcaggtattaatatggttagaattgttcttacaactggtaattatagtcaatagagataaaacagatgatgtactgacaaatttttgtgaacttagattttaaagaaagttgttgtataatcatatcatttaaaaatactacattagggctgggcatggtggctcacacctgtaatcccagcactttgggaggccgaggcaggtggatcacgaggtcagttcgagactagcctggctaatacagtgaaaccccatctctactaaaaatacaaaattagccgggcatgggggcgcgcacctgtagttccagctactcgggaggctgaggcaggataattgcttgaacccaggagatggaggttgcagtgagccaagattgccccactgcactccaccctgggcaatggagtaggactctgtctcaaaaaaaaaaaaaataatggatcttataaagtacttgtgtggagctttgattccacagaataaaagatattggggtgttaaaaaaagagaaaaaagagaagagaagaatagaaaaagaaaaaaag

SEQ ID NO: 345303 - DNA, 1354 bp, Homo sapiens
cgccccgggtggcctccgcccggaagacggaagtgcaaagacttccggtcggcgtgagcgtgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtaccccccccccccccaaaaaaaaaaatttttttaaaaattttttgggcggggggggaaaaaatatggatgaaccaaaggcaaagaaaaaggctgaaggcaaagcgagagaaaagaaaggggaaaagcaaagcaaaagcagtgaaagtggcaaagggtttggcctggtagactcttaaaaccttggaaaatgccacatgggatagatgacggattagaatgtatacacatgtatactttgatttcaactgccaccaaatgaaaaccatttgttttcctattttaacttggccttttttcttcaattcaaacccagcataactcctcaagtttgttttgggaacttgaataaaatattttctttgatacatccaagctctactgatactttaactggatgctacccaatatccagttataatcaggcctcaacgttctgtcaggtattaatatggttagaattgttcttacaactggtaattatagtcaatagagataaaacagatgatgtactgacaaatttttgtgaacttagattttaaagaaagttgttgtataatcatatcatttaaaaatactacattagggctgggcatggtggctcacacctgtaatcccagcactttgggaggccgaggcaggtggatcacgaggtcagttcgagactagcctggctaatacagtgaaaccccatctctactaaaaatacaaaattagccgggcatgggggcgcgcacctgtagttccagctactcgggaggctgaggcaggataattgcttgaacccaggagatggaggttgcagtgagccaagattgccccactgcactccaccctgggcaatggagtaggactctgtctcaaaaaaaaaaaaaataatggatcttataaagtacttgtgtggagctttgattccacagaataaaagatattggggtgttaaaaaaagagaaaaaagagaagagaagaatagaaaaagaaaaaaag

SEQ ID NO: 345304 - DNA, 391 bp, Homo sapiens
  misc_feature (350)..(351): n is a, c, g, or t
  misc_feature (353)..(353): n is a, c, g, or t
  misc_feature (356)..(356): n is a, c, g, or t
  misc_feature (362)..(362): n is a, c, g, or t
  misc_feature (365)..(365): n is a, c, g, or t
  misc_feature (368)..(368): n is a, c, g, or t
  misc_feature (372)..(372): n is a, c, g, or t
cgccccgggtggcctccgcccggaagacggaagtgcaaagacttccggtcggcgtgagcgtgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagaaaaaaaaaaaaaaaaattgtggggggggccggggccccggaaaagnntnttntaaganccnttncggngggggcgcgcgggggcccc

SEQ ID NO: 345305 - DNA, 738 bp, Homo sapiens
gctgaggcaggagaatcgcttgaacccgggaggtggaagttgcagtgagccgagattgcgccattgcgctccagcttgggcaacaagagcgaaactccgtctcaaaatacaaaaaaacaaaaaaaacccagcctcacggagcctacatggtggggcggggggataaacagaaaatctgcaaagcgtaaaccatgggagcaattgtatttatttttaggagattgcaacattatttaggtgatgaccagaaggaggccttagttttaaaggcctgaaggggcagcagggaacagcattgcaggcagagagaacagcagctgcaaagcccctgaggtcacctgccaaggtatcagaggaaggtcaggggaagtgagagatgagatggagatggacagggaagatggtacatggccagataaggattttgacttttgctcagagtgagcttagagtcggtgcagttctgagcagagggtaacaggatccagcttgttttaacagaatccctctggttgctggcttgaggacagacaagggtggagagacataaggaggttgtaataatccaggcgacgcctgtggcggcagtggggtggtgagtcacccactcttaggtgagttggctgaagccaacagaatgtgctgatataagctgtgagaaaatgaggagctgactttgacttcagaggttcaggctgaacttggggaaggacggaggtgctgtgggtggagacaggg

SEQ ID NO: 345306 - DNA, 1241 bp, Homo sapiens
aagatggctcccacattcttacagtgggagtcggtgcgaatatcttcatgtatggaaggctttcaggaattgtgactgagcaaaccaacagtaaggatggagtagctgtcatcactttaccactaggtggtagtatcaagcaaggagttaagtcaagatgggttcttcttagatctatagacttggtatcttctgttgatggtactccttcactgcctgtttctctctcttgggtaagagatgggatattggtggtaggaatggattgtgaaatgcatgtatatgcacagtggaagcatgctgtcaaatttggagacactgaagctgatagttctaatgcagaagaggcagcaatgcaagatcattcgacctttaaatctaatatgctggcaagaaaaagtgttgttgaaggaacagctatttctgatgacgttttttgttcaccaactgtaattcaagatggtggcttatttgaggctgcacatgtactttcccctactcttccacaatatcatccaactcagctgttagaattgatggatttagggaaagtgcgaagggctaaagccattctctctcatttagtaaaatgtattgcaggtgaagtagcaatagttagagatcctgatgctggagaaggaactaagcgacatctctctcgaactattagtgtaagtggcagtacagcaaaggaaacagtcaccgtaggaaaagatggtactcgagattatactgagatagattctatccctccactaccactatatgcattacttgctgcagatcaagatacatcctacagaatttcagaagaaagtacaaagataccacagagctatgaagatcagacagtaagtcaaccagaggatcagtattcagagctgtttcaaatccaggatataccaacggatgatattgatttagagcctgaaaagagagaaaacaaatcaaaagtaataaatctttctcaatatggaccagcttactttggccaagaacatgcaagggtactttcaagtcatcttatgcactcaagtctaccaggccttacccgtttggagcagatgttccttgtagctttggctgatacagtggctactactagtactgagcttgatgaaacagagataagagttgctcaggaagagatacattagatgagtgtggtttgagatacttgttagctatgcgcctacacacatgccttttgacatcgctgcctcctttataccgagtgcagc

SEQ ID NO: 345307 - DNA, 289 bp, Homo sapiens
tcgacaacttccagcttctccagaagtggcaaataactttccaactgggtatccacacagaaatatgtgagcatgcttacatggcatgtgctgccccacctccccctgtgaggagcttggttacagctacagcatttctacaacctctttaaaccaactttgtagtatccggcagcaaagtatcattccctgacattcgagtcattgagtctctgaagacttggaaaagggataataagccaaatcattcaggaaccagggggtcccagagaggtatgtaataaatttc

SEQ ID NO: 345308 - DNA, 351 bp, Homo sapiens
ccacatgttgtgggagggacctggtgggaagtaattgagtcatgggggcaggttgaaaagggtagtttctctgcagaagctctatctttgattgctgccatccatgtgagacatgacttgcttctccttgccttccaacgtgattcttaggcttcctcagctatgtggaagtgtaagtccattaaacctctttcttttgtaaattgctcagtctcagtcaggtatgtctttatcagcagtgtgaaaacagactaatacacctttgttccttttttctctcattatttatggttgcagtttggtggttttctttagtggtgatgtttgaatcctttcttctttgtgtgtctg

SEQ ID NO: 345309 - DNA, 324 bp, Homo sapiens
atacgtctcacaaggtctgatggttttgaaaagggtagtttctctgcagaagctctatctttgattgctgccatccatgtgagacatgacttgcttctccttgccttccaacgtgattcttaggcttcctcagctatgtggaagtgtaagtccattaaacctctttcttttgtaaattgctcagtctcagtcaggtatgtctttatcagcagtgtgaaaacagactaatacacctttgttccttttttctctcattatttatggttgcagtttggtggttttctttagtggtgatgtttgaatcctttcttctttgtgtgtctg

SEQ ID NO: 345310 - DNA, 596 bp, Homo sapiens
cgcctgttagatatttttttttctctttttcagagggtcatttcatatattgtgtgagccccacaaatgtctattttaaaaagagtatagtccctggccaggtgcagtagctcacacctgtaatcccagcactttgggaggcagaggcaggaggatcacttgagccccggagtttgagatcagcctggttaacatagcatgaccctacctctaccaaaaatttaaaaactagctgggtatggtggcgtgcacctttagtcccagctacacaggaggccgaggtgggaggattgcttgagcctggaaggtcaaggctgcagtgagccatcatcatgcaaatcaatttaaagaaaaacaataaaagtgttatgttgatatggcaaaaatgaaaagatgatcaagattgaagcttgtgaaatgctgcattaagtaacccttttatatcttctcttttctgcatgggatcggagaaatggaaggattttcattttacaggaaagggagctgagatctagacaagtgacttgcccagagctgtctgcattgtctctggctgtcgggactctaagtaggactcattgctcccaggcaggtgc

SEQ ID NO: 345311 - DNA, 242 bp, Homo sapiens
cgcctgccaccatgctcggctaatttttgtatttctagtagagatggggtttcaccatgttggccaggctagtctcaaactcctgacctcaggtgatctgcccacctcagcctcccaaagtgctgggattatataatcttaaattctagtcatcactttttaaaactcacaatatagaatcttccagtttttctactttctactttttttttttgagacggaatctcgctctttcacccagg

SEQ ID NO: 345312 - DNA, 471 bp, Homo sapiens
aagtcaacaggaaggtggatatccaaatctctctcttcgcaatgagtttccagttagatggaggagagagtaataaaacacagagctgagattcctgacttcacagatccctgaggagatgtttactaaagggaatcttctggtcactgttaccttcctccgtacttacctgcctcatggataacactgaagaatgcagtttacttacatctttttctgtttgacagaagacagttattagaacccgaaaggaagaagctatacgactggggacacatgtcttagaagcacactcattagataaagtgtcgcatactctttgataagtgactcagaacacccgtgtccttcccaacattggatgcaatgctaaagacatgatgttgctcctgctggaccacaccttgaaggaattgcctaccccacctcacctccaaaattaaagtctttcgttttgacaaaagttaaaaa

SEQ ID NO: 345313 - DNA, 412 bp, Homo sapiens
aagtcaacaggaaggtggatatccaaatctctctcttcgcaatgagtttccagttagatggaggagagagtaataaaacacagagctgagattcctgacttcacagatccctgaggagatgtttactaaagggaatcttctggtcactgttaccttcctccgtacttacctgcctcatggagaacccgaaaggaagaagctatacgactggggacacatgtcttagaagcacactcattagataaagtgtcgcatactctttgataagtgactcagaacacccgtgtccttcccaacattggatgcaatgctaaagacatgatgttgctcctgctggaccacaccttgaaggaattgcctaccccacctcacctccaaaattaaagtctttcgttttgacaaaagttaaaaa

SEQ ID NO: 345314 - DNA, 674 bp, Homo sapiens
gagtacaggcttggtccacagagacaacaatactttcaatactctttgttctgccccagaggagctcaacacagaatgcctagaacaagaaactggtgagagaagctgcagcctgttgagactccacaagactgaagatatgaaaagaggaaatatgcatgaatgcccgcacggagaaccacccccacctgctgctcccgctctaatgatcacgcccattatcaactgggggatggctctgtgccttgtccttgcattacatggaccaagaacacttcacaggactcagagaggaacccgaaaggaagaagctatacgactggggacacatgtcttagaagcacactcattagataaagtgtcgcatactctttgataaggatcttgctctgtcatgcaggttgaagtgtgtggtgcgaccgtgactcagtgcagcctccacctactgggatcaagtgatcttcccatcaggcctttcaagtagctgggactgcagtgcacaccactatgcccagctaattatttactgattttttttttttgtagagatagtctcactatgttgcccaggctggtcttgaactcctgggatcaagcgatcttcccaccttggcctcccaaagtgctgggattacaggtgtgagtcactgcaaccagtctgggtatgatattac

SEQ ID NO: 345315 - DNA, 389 bp, Homo sapiens
ctcttgccagtgttacagacagtttaaaatctcttagggcatcatgaactacacaaaaagtgcctgaggagtggccaaaagtgagaagatagctaccaattggtggggcaccatcaaggcaaggagaagagtgactagtggcactgagaaacctcgctgagaaagctgatcagagagaaggtcccaagaggctggaagatcctctcatctcaggctgacattgggactccccttggattatctttgtatcaggagggcctcagaaggtttctctgaatgtagatgcctttctaccttgcaaggctggcaggtggttacaaagggcacaggctttccaagtgctcaaagagaggacaaaaacttctggaaaagcacttggtgcagccgta

SEQ ID NO: 345316 - DNA, 1023 bp, Homo sapiens
ctcggaagtagcatcttctctccacaggccaggcacttagaagatgctggcaacgttttatcccttgaacagggtggcagttatatgattttctgtttctttaataattccttaagcttatttttatcttttatgcacagtttgtaagatgacggttcaaatctagtgtttgaagaactgtatgaaacaggtttggaagggaacagacggcccacgtcacagggagagataggcgggttcccagactagctgacagttagggccatgtgcctccctgagataccagagtggcccacgttgctggccgtgccaaatgctatcctacagcatcggcacctgctgggggaagcaggggggaaatgcctcaagtatttctattggttaaaacctcggtgtgagaacactgcttttggccactcaaggaagacagttcatcaaacaccagggagtgggacttctggagcaaagataaaagaattcatggctgcactacaccgattctgaaaaggaggaacaaacgccccgtttggaacagaatctggcccatcccatggagagggccactgtgcctgacagatttgttggggtgaatctgggtgcccagggatcaatatggcaactctacactcttgctggcgagggaactggaggccagcaccaaggagacccaaacaggcctcccagccaggcacagcccagggcaccctgggttagcctgatcccgccctggtgcctgggtccttcacgcggctctcctgtagactttctattaagaaatgcctgtggtagagtcaggcgggtgagaagtctacactccttggcagtaccttgaaaggaaaaatcgtcacagataaaaaaaataaacaggtgagaaatatcaacgcagcagcagcagtgttgaaagggacacagcttgaggggtggatctgggggtgaaattcaggttaagacggagtgcagggtgctagaagctgccacgcaggttgatgagccacgtgctatgaaagccaggagccactgacc

SEQ ID NO: 345317 - DNA, 864 bp, Homo sapiens
ctcaattcccctttcttttatgttggttttactgtgagactggttagggttggcaaagatgaccccagagcaggggttggcatgtttttctgtagagggccacatagtaaatatctgagggctttgcgggccatatggtgtctgtctggcacaacaatgtgactcagctctgctgttgtagtacaaaagcagcaggacatgatatgtaaatgaatgggtatggctgtgtgccataaaactttattcattgacactgagatttgaatttcttgtaatttttgtgtctcacaaaatagtcttctttcttttttttttaatgtaaaaaccagccgggtatggagactcatgcctgtaatctcaacactttgagaggcttaggcgggaggatcacttgaagccaggagttcaagacccacctggggaacatagcaaaaccccatctttatattttaaaaaaaagtaaaaactattagctcataggccatccaaaaacaggtggaagaggctgctggatttggcctgtgggcactgagcttactgagcttacatcttcccagctcagtaagcctggcagaaggtatctctttcccagtagttgggggaaaagtcccagggtggactctcattggacagacttgggtcacatgccccttcttgagccaatcagaggcagaggggcttggtgctttcaggggattggtcagtggtagacacagcctgatgagggtagggaagagggagaaaccaaaaggaaaagccacactgttgccgaagttggaggcagcaagcgccgggtgggtggaagtcacaaaaatccactgctgaggtggcagtagggatgggatgttagctgtgccataaaag

SEQ ID NO: 345318 - DNA, 375 bp, Homo sapiens
agcacaagcatgtagatgtgttgttgctttgcctctcagaggtaaacctatatgacgttttcaaaaagtggataattgaaaaagtgaatgaactgatgaagaatgaaagtaaagaaaagaaaggaggtaataatgctggaagtgaaattgaagtcaaagtaaatggagttatggaagaaacagctaaccgtgggaatgctaacactgccatggtgcaatagactccagatatgaagccagaggagtctagtgaagctgaattttttgacataaatgaggagagtggttgtgagaaaaagaatgaagatattccagagggagtgacactgtcaccttcctcttggagacatttcataatgttgggtgcgctttgtg

SEQ ID NO: 345319 - DNA, 212 bp, Homo sapiens
aattacggtttcttcaatcaaattcagacattagaattgaccttgaaaattggtctacttggtgggcaataattatcctatctctttctctctcacacacacacacacacacacacaatttgttaagtgaacagaacaaatgaacaaagaagtaggcagaaatagtagtatataaattgaggtaaatgaactacaatatcatctttcacaaa

SEQ ID NO: 345320 - DNA, 1013 bp, Homo sapiens
actgtattttcatcatcagttatccctagtgattcaaatttagcacaaacctgctgtgagtacatattaattaggtgaatacagtagaatgcaatcataacatgagtcttttaataactattctttgtttgatttttattttagaagtttgaagttattttgttgaaaatctagaaaatctttatgtgagcaactgaggttcgggtagcccacaacagtttaaatcaaacattaacttgcagtaaaacactactgaaagtgtctttgattttgaggtgcagagagctgtttcaagttaagttgctatattagtctgttctcatgctgctaataaagacatacctgcaaccgggcaatttattaaaaaaaaaaagaggtttaattgactgacagttccacatggctggggaggcctcaccgtcatggtgaaagagcaagggatgtcttacatggtggcaggcaagaagtttgtgcagaggaactcctgtttataaaaccaccagatctcatgagacttactcactaccaggagaacaggatgcgggaaaccacctcggtgattcagttatctgcacctggccccacccttgacacatgttgattattacaattcaaggtgagatttgggtaggtacacagccaaaccatatcagctgcccattctcctgtgcagtgacataaaggtctgataacctgatttaaagcttggactctaagatttttttttttctttttttgagtcaggttatctctgtcgctcaagctggagttcagtggcatgaacagggctcattgcagcctcaaccttccaggttcaagtgattctcttgcctcaacctcctgagtatctggggctacaggcatgtgccaccgtgccaggctaatatttttatttttatttttgtaaagatggggtctcacttctgggctcaagcaatctttcctcagcctcccaaagtgctgggattataggtgcgagccactgcaccctgctgtaaagaatttcatatccc

SEQ ID NO: 345321 - DNA, 434 bp, Homo sapiens
ggggagtttgaggggtagttactacttaaaattgccaattgtgataagcacctcatatgtattatttaaactgtgaaaattctgtgaaatggaggctataattaatggctgttttgcaagttaagaaactaaagcccagctgcaggttaaataattcacccaaggttacaaattaataaatagtggagccagatactcaacccaggcagtctgactctggaactgtgtgttcttttccatatctatattcaatcaagtctattctttcaacaaatatttatagcctattatgtgccaaactttcctttaagcattgggaatacaatggtaaattaaaccatcaagttgcttgatctcatgaaaaattacttgtgagacagttgcagtaagtttttctccaggatgaaaaaatagcctctttgtacagagtttgt

SEQ ID NO: 345322 - DNA, 564 bp, Homo sapiens
aagtcagaggttctctcccttagtgttttctgccaccactgctataatcctgactgctggacattggttgaaaatggcgcattgccactagagtgttctcgtgaagctgcttgagcctatatggagagaggtgggcataaaagcaggttgtagaggggtcaggtaaatacttaagataaaaatattttaaaagtttgaactggccgaaatcgcaccactgcactccagcccgggcgacggcgagactccgtctcaaaaaaaaaaaagtttgaactgctatctataccccataaaatgcaaatttttagtagcttgtgtttgtgcaaattgaatatttgtagctgtaagccattagcactacagtaattacttaaatactaatttttgttcaaaatgcaacagtaattgtagacattaattacagaatctgggtggtacgcaggtgtttgaggtaaaatttattcagttattctgtatgtttaaaaagttttataataaaatactggaagagatctaactgcctatgactttattcagaagtacaatataatttaatatagctgt

SEQ ID NO: 345323 - DNA, 435 bp, Homo sapiens
ctctcttttcgccacactcctttcacaagacctgatcataagacctgtggcatcctataccagcagaacgtttacagtatctaccataataatgataataataataataattgcttacatcagttgacccaattattttatatttggtgctgttctaagcactttatatggattactttcatttaatcctcttggtagtcccatttgcagatgaggaaactgaggcatagagaggttagataatttgctccaggcacatgagcactcagtagcagggcaaggcccctgacccagtctgactctagagccggtgcttgcaattaccataatgcctgggtttacctgactgcctgtcttgtactcccctatttgcatctgataattgtgaattcattccagaggaataccaagaaccctagttaatttgttagccaa

SEQ ID NO: 345324 - DNA, 385 bp, Homo sapiens
cataacagcagtgagcagggtgacttaaggtaaagagggataaaggtgacactattggtaaatacaagtttgttacaaagaaacatgactctagggacatactgaactatgaatagttgctccacctacttccccagaattcttctatgcagagccctgatccacaaattattttagtgattgcttacatctttgtctgtagtagggaacactgagtgagactaacctagcagaagggggcactgagatgaatgcacacacgtgtgaagctcctgctgatacacttccaaagacatgctatgttagcattcgatgcaattgcaaaaaattaaatccattaaagtggccagctgcttctcctctccatggaaggaggaaaacatct

SEQ ID NO: 345325 - DNA, 670 bp, Homo sapiens
tcttacactcctacaaagacaaagaaaatcctgggagggattttaagacacgtgctcatttcagcactctgtcctcctggtgacatctctctatgaagcatctgggacttcacctgacaagcacctgacaacctgactgagcactcggcccttactgtatgtgcctcagtttctacgtgcatcatgtgagaaaggcagattgtatccatggctatgagactgttgggctttgttggacaatgaagacgtcccccaaatatgtaaagactgacaaacgacggccaccctttatatttttcaaagtgaaggcattgaaggaaagatgcaatcgtagaccgccatggtcagtgaattattttatgagagatcacccttctagaaagtgcagccaggtgcagtggctcatgcctgtaatcccagcactttgggaggtcgaggctggtggatcacttgaggtcaggagatacagaccggcttggcaaacacggtaaaaccctgtctctactaaaaaatacaaaaattagccaggcttggtggcaggcacctgtaatcccagctactcgggaggctgaggcaggaggatcgcttgaacccaggaggcggaggttgcagtgagctgagatcgtgccattgtactccagcctgggcaacagagcgagactctgtctca

SEQ ID NO: 345326 - DNA, 593 bp, Homo sapiens
tttgtctttttagtagagacggggtttcaccatgttggccaggctggtctcaaactcctgacctcaggtgatccacttgcctcaacctcccaaaatgctgggattacaggcataagccacggcacccaggctggacatctattctttaaagaactctgtgttaccaaattcagttctgcaatctgtcccaagaacttccttttctgtgccctaagttacgatagaggaagaggcacatcaaacccaggcctgcctgcctttctttctttccttcttttctttcctccttttctttctttttctttccctctttctttctttctttttctttctttctttctttctctctctctctttctttctttctttctctctctctttctttctcttccttccttcctttctttctctctctctctctttctttcttttcttctttctttcttccttctttctttttgtcttgctctgtcacccaggctggagtgcagtggcacgatcttggctcattacaaccaccacctcctgggtttacgcaattctcctgcttcagcctcctgcatagctcagattgcaagggcacaccaccacac

SEQ ID NO: 345327 - DNA, 592 bp, Homo sapiens
ttgaggtttgtaagtttattcttatcactgactagggtacccaaattcttgcatttgtctccttatacacatctaacatatcaccaaagacaaataaagatacactctggcccaatctttgcttaaaaattccaaagcactaggagcactttaagtttggtctcgaaaggagttgtttataaaatcaaagggctaccgattccctgttcatcctgcactgaagcacatgatgacagtatcaaaccttcatttttgttcattaaaaagtgaatttcattacttaagtgtgtaattctatagtgattagcagtatttgttttcatcatttcacttgggtggccattaattttgaaacctttaccactcattgtagttggttgtagttttatggaaaatgtaatttatagctaaagtggcttttttatgcatagctgccttttttattgtttaacagtgtttctcagctatataatcagtttcaaactggttgtaaaagtatagctgtggccaatgaatgtatttatttgttgtttcactaaattgtaacaaaacactactattaaaaataaaagtgtttgtgcttttatttaga

SEQ ID NO: 345328 - DNA, 302 bp, Homo sapiens
aaagaacctaaaaaggaggacataccacatagaatcggtaaagcagctaagcagaggctttggaggccaaggaccaaagtatttctttcaagaaaccaaagcagcagccaatttaagtctaaatttaagtctaaatatcctaggtttttaactctaaatatcttcattttacagataagtaaacaggagctcagagagtttaaataagttgttcaagttcactcatctatttagtggcagagccaggaacttactcaagttttccatacacttccaatcccaacattcagagactcagaagt

SEQ ID NO: 345329 - DNA, 537 bp, Homo sapiens
taagaaggggtcttgcccaggctgctggagtggtgcagtggctattcacaggtgtgatcctcatgtactgcagccttgaactcctggcccccggtaatcttcccacctcagcttcacgatcagctgggactataggttcacaccaccatgccctactacagcaactattttagatgtctataaatagatttacagaaaagttgcaaagagaatagacagaatactcctatctataccttctacaacaggggaaactgtttctgctgttgttaatatcttacattagtatgatatatttgtcacagtcaatcaaccaatattgatatttttaaaaaactaatgtccatattctattcatatttccttagttttgacctagtgtcctttccttgttccaggatcccatttaggataccacattgcatttactcatcatgccttcttacgttcccctataccacgagttttctcagactttccttgtttttgaaaaccttgactgttttaaggaatcctgctcaggtattttgcaaaata

SEQ ID NO: 345330 - DNA, 397 bp, Homo sapiens
gtgcaacaatttgagataccatgctaaatcctatctgaaaggcttgaaccccttttgctgctgccacaaatgtctgagaatgcccttgtcaccaaaccaacatggcacttaatatttcactgttttaaatgttggagaatattgttgtccatttctggtggaaccatagtctggcgacagaatggcttgcctgacacagcttttgatcaccagccccaagtccttctccctccccttccccttatcctttggtgctgatccagcccagtttataggttctgttacatctaacttcccaactgtctctagtctggtcacttctccccatctgcccagcaaagatgaggtcgatttgacttgtaaaagattaccttttctaaacagtttaaaaaaaaaa

SEQ ID NO: 345331 - DNA, 626 bp, Homo sapiens
ggccgtatgagcagtgtggagctcttaccttgctatagaatttctctcattctggaaagtaagttttcaatttaactgcttttccctgaaatcttctgaaccaccccagtgatgatatgaatgtagctccctctggtgttgacaaggacttgctatatcagtaatacccttattaattcaagcccaatcacttttagagctggacctagctaggttcttggagaccatttagtccaattccccactttaatctctgacatgaaatctactaaggtaaagtgacttgccagaggtaccgctagttagtagcagaatctgaatcagaaaagaaagactcaaaactcacaaattgagcattattttctgctgcctcccgtaaagatgcccagtgtttaggtagagaccattagatatttgaagttgggcatatctgcctgatctgggataatggccaattaaagcttgtttcattaatggtggggcagtgagtgtgccaattagtctaacagaaatacttattgactatataccatctgccagactatgtgccttaaagatgaaacagtcattatgatacaatccctgccttctaggagcttccagtccgtgaggggtacagatagtta

SEQ ID NO: 345332 - DNA, 178 bp, Homo sapiens
atttaatttgtcaaaaaagttctgaaattttcaaagcaaaagcaattttaatttaattgctctaaaaaataagcagatttatcatttagcaattctttaagggagagtgtatcataaaactgaaatagtactgaatgtggcagaatcaaacaagttgaaaatctcatcacttcagagc

SEQ ID NO: 345333 - DNA, 373 bp, Homo sapiens
ttgcagtgagccgagactgcaccattgcactccagcctgggtgacagagcaagactcccgtctcaaaaaaaaaaaaagcattgtattatttttctgccctcatacatttgtgaaagggagggcaagctggtaaaagcctaatacatgttggtatttcggggtggggagagtacttcatttacaaagccagtatagtaaaatgagccccacaaaaggaaataaaatctatttggaaactatgaaaaaataacctgctaaatctcattctctgctcctctacaaattcactctaagtaatgttttcagagtttcacaggtcaaagatgttgggggtaaggtgagacctaaatcttgctccctttttaaaaaaaaa

SEQ ID NO: 345334 - DNA, 234 bp, Homo sapiens
actagtcagcaggttttgtgtttttttttcacctaccattttcagctctatgtgtgcaggtgaagagtcgaatttaaccaagattgtgatttagggtattttagctgggtgagaaggaaaataaaaacaccaagagctgagggacagtggaaatatgatagaatcaagagataatgaaaggtttgaagaatggaggaatcagagttgttggattgttgtgtagtagggggtgaa

SEQ ID NO: 345335 - DNA, 493 bp, Homo sapiens
gatgtaacattttaaaacctatgttactagtctcatttgccaaatgaaacttaattttatgaacttggattcttaaaatattactgaattggctagcagtttctattaaaagaatttttatgtttaagtctagcaggttcaaaatattagaggtttgatgttctgtgattttaggaggattcaacttataaaagcacttgtttatcaaacaatcagaacaagttcttttaatttaaaaggtatcgtaatccaatttattgacaccctctggaaataggaaagcattccacacacagcaagaggtgaaggcttttctggattataaacacatagacacacacagcttaatagctttagtttttcaacttcagccacagatcaagaataaatagaaacacaaaaaaatcaccagtccagatatcaaagagctgttctccttcccagtagaaacaaaattcttcattgatttgagctcaaaatagacgaacataca

SEQ ID NO: 345336 - DNA, 387 bp, Homo sapiens
gatcgcatgggcaagggaatctggaaatctctgttgtgccctgatggtacaggcagtggagtgggcaattctgcgaaccatgcaggaaaggtttctgatcctatattcattccaagcagggtctagcccaaaccaggaccccagaatcccttcccatttagatccttcactagagttaagcctaccaggtaaatcacatccttaggagtatccacagctatcatctttataatctgaggggctatcaccagcatagtcatcaattattggtagagctcttttggccctgggatgtagactctacattccctgagttagagacttaataacagtgacaggagcaatggcttgacccagaaagcaaatgcctgtgttttctcaggaccc

SEQ ID NO: 345337 - DNA, 4466 bp, Homo sapiens
gtctgcgtaaccgcacgggaaacccgccaccacctccacctccctgccatcctcgacaagatgcctgcccccggcgccctcatcctccttgcggccgtctccgcctccggctgcctggcgtccccggcccaccccgatggattcgccctgggccgggctcctctggctcctccctacgctgtggtcctcatttcctgctccggcctgctggccttcatcttcctcctcctcacctgtctgtgctgcaaacggggcgatgtcggcttcaaggaatttgagaaccctgaaggggaggactgctccggggagtacactccccctgcggaggagacctcctcctcacagtcgctgcctgatgtctacattctcccgctggctgaggtctccctgccaatgcctgccccgcagccttcacactcagacatgaccacccccctgggccttagccggcagcacctgagctacctgcaggagattgggagtggctggtttgggaaggtgatcctgggagagattttctccgactacacccccgcccaggtggtggtgaaggagctccgagccagcgcggggcccctggagcaacgcaagttcatctcggaagcacagccgtacaggagcctgcagcaccccaatgtcctccagtgcctgggtctgtgcgtggagacgctgccgtttctgctgattatggagttctgtcaactgggggacctgaagcgttacctccgagcccagcggccccccgagggcctgtcccctgagctaccccctcgagacctgcggacgctgcagaggatgggcctggagatcgcccgcgggctggcgcacctgcattcccacaactacgtgcacagcgacctggccctgcgcaactgcctgctgacctctgacctgaccgtgcgcatcggagactacgggctggcccacagcaactacaaggaggactactacctgaccccagagcgcctgtggatcccactgcgctgggcggcgcccgagctcctcggggagctccacgggaccttcatggtggtggaccagagccgcgagagcaacatctggtccctgggggtgaccctgtgggagctgtttgagtttggggcccagccctaccgccacctgtcagacgaggaggtcctcgccttcgtggtccgccagcagcatgtgaagctggcccggccgaggctcaagctgccttacgcggactactggtatgacattcttcagtcctgctggcggccacctgcccagcgcccttcagcctctgatctccaattgcagctcacctacttgctctccgagcggcctccccggcccccaccgccgccacccccaccccgagacggtcccttcccctggccctggccccctgcacacagtgcgccccgcccggggaccctctcctcaccgttccccctactggatggcttccctggagccgaccccgacgatgtgctcacggtcaccgagagtagccgcggcctcaacctcgagtgcctgtgggagaaggcccggcgtggggccggccggggtgggggggcacctgcctggcagccggcgtcggcccccccggccccccacgccaacccctccaaccctttctacgaggcgctgtccacgcccagcgtgctgcctgtcatcagcgcccgcagcccctccgtgagcagcgagtactacatccgcttggaggagcacggctcccctcctgagcccctcttccccaacgactgggaccccctggacccaggagtgcccgcccctcaggccccccaggccccctccgaggtcccccagctggtgtccgagacctgggcctcccccctcttccctgcgccccggcccttcccagcccagtcctcagcgtcaggcagcttcctgctgagcggctgggaccccgagggccggggcgccggggagaccctggcgggagaccctgccgaggtcttgggggagcgggggaccgccccgtgggtggaagaagaagaggaggaggaggagggcagctccccaggggaagacagcagcagccttggaggtggcccaagccgccggggtcccctaccctgtcccctgtgcagccgcgagggggcctgctcctgcctgccactggagcggggggacgccgtagcaggctggggaggccaccctgctcttggctgcccccacccccccgaggacgactcctcgctgcgggcagagcggggctccctggccgacttgcccatggcccccccgcctcggccccccccgagtttctggaccccctcatgggggcggcggcgccccagtaccccgggcgggggccacctcccgctcccccccccccgccgccacctcctcgggcccccgcggacccggccgcgtcccccgaccccccttcggccgtggccagtcccggttcaggcctctcgtcgccgggccccaagccgggggacagcggctacgagaccgagacccctttttccccagagggagccttcccaggtgggggggcggccgaggaggaaggggtccctcggccgcgggctccccccgagccacccgacccaggagcgccccggccacctccagacccgggtccgctcccactcccggggccccgggagaagccgaccttcgtggttcaagtgagcacggaacagctgctgatgtccctgcgggaggatgtgacaaggaacctcctgggggagaagggggcgacagcccgggagacaggacccaggaaggcggggagaggccccgggaacagagagaaagtcccgggcctgaacagggacccgacagtcctgggcaacgggaaacaagccccaagcctgagcctcccagtgaacggggtgacagtgctggagaacggggaccagagagccccaggcatcgaggagaaggcggcggagaatggggccctggggtcccccgagagagaagagaaagtgctggagaatggggagctgacacccccaaggagggaggagaaagcgctggagaatggggagctgaggtccccagaggccggggagaaggtgctggtgaatgggggcctgacacccccaaagagcgaggacaaggtgtcagagaatgggggcctgagattccccaggaacacggagaggccaccagagactgggccttggagagccccagggccctgggagaagacgcccgagagttggggtccagcccccacgatcggggagccagccccagagacctctctggagagagcccctgcacccagcgcagtggtctcctcccggaacggcggggagacagcccctggcccccttggcccagcccccaagaacgggacgctggaacccgggaccgagaggagagcccccgagactgggggggcgccgagagccccaggggctgggaggctggacctcgggagtgggggccgagccccagtgggcacggggacggcccccggcggcggccccggaagcggcgtggacgcaaaggccggatgggtagacaacacgaggccgcagccaccgccgccaccgctgccaccgccaccggaggcacagccgaggaggctggagccagcgcccccgagagccaggccggaggtggcccccgagggagagcccggggccccagacagcagggccggcggagacacggcactcagcggagacggggacccccccaagcccgagaggaagggccccgagatgccacgactattcttggacttgggaccccctcaggggaacagcgagcagatcaaaggtgaggaggctgcggggcacagtcagggccgaggtccggctgtttccgaggcgtgcggagggtgagtgtgggtaaacatgtcgggtcgggctggcagtgatgaatgcaggtcctgaagcctgcaccacctgggctcacatcgcggctcagccccctctctagctctttggccttgggcaaatgtccttgctgcacggtgcctcagtttacccatctgccaaaaacggatggcagggatagaacctacgtcatagggttgctgtgaaggttaaatgaattaggacatccaaggcacttaatcagagcaagggattcagtaagcacctgcttttattattgcaactcacttagaccaggggtctcaaactcatgcccacaggggccagacgacatagggaaacggatgaagcatgctagggaggcagagtggggcttcagaagaaaatgccctgtgtagaaggggcagccacttctcaggaatgtgcacctggtgttggcgaatctgctacttttcccttttaaactagagctctggtttttatttcttttgtttttatggttgcagccagttcaaaggaagcctgtctgtggatggctcaagggccccaggctgccagcgtgtgctgatttaaacttaataagctggctgggctctgtggctcatgcctgtgatcccagcactttgggaggctgaggcaggaggatcacttgaggtcaggagtttgagacca

SEQ ID NO: 345338 - DNA, 4417 bp, Homo sapiens
gtctgcgtaaccgcacgggaaacccgccaccacctccacctccctgccatcctcgacaagatgcctgcccccggcgccctcatcctccttgcggccgtctccgcctccggctgcctggcgtccccggcccaccccgatggattcgccctgggccgggctcctctggctcctccctacgctgtggtcctcatttcctgctccggcctgctggccttcatcttcctcctcctcacctgtctgtgctgcaaacggggcgatgtcggcttcaaggaatttgagaaccctgaaggggaggactgctccggggagtacactccccctgcggaggagacctcctcctcacagtcgctgcctgatgtctacattctcccgctggctgaggtctccctgccaatgcctgccccgcagccttcacactcagacatgaccacccccctgggccttagccggcagcacctgagctacctgcaggagattgggagtggctggtttgggaaggtgatcctgggagagattttctccgactacacccccgcccaggtggtggtgaaggagctccgagccagcgcggggcccctggagcaacgcaagttcatctcggaagcacagccgtacaggagcctgcagcaccccaatgtcctccagtgcctgggtctgtgcgtggagacgctgccgtttctgctgattatggagttctgtcaactgggggacctgaagcgttacctccgagcccagcggccccccgagggcctgtcccctgagctaccccctcgagacctgcggacgctgcagaggatgggcctggagatcgcccgcgggctggcgcacctgcattcccacaactacgtgcacagcgacctggccctgcgcaactgcctgctgacctctgacctgaccgtgcgcatcggagactacgggctggcccacagcaactacaaggaggactactacctgaccccagagcgcctgtggatcccactgcgctgggcggcgcccgagctcctcggggagctccacgggaccttcatggtggtggaccagagccgcgagagcaacatctggtccctgggggtgaccctgtgggagctgtttgagtttggggcccagccctaccgccacctgtcagacgaggaggtcctcgccttcgtggtccgccagcagcatgtgaagctggcccggccgaggctcaagctgccttacgcggactactggtatgacattcttcagtcctgctggcggccacctgcccagcgcccttcagcctctgatctccaattgcagctcacctacttgctctccgagcggcctccccggcccccaccgccgccacccccaccccgagacggtcccttcccctggccctggccccctgcacacagtgcgccccgcccggggaccctctcctcaccgttccccctactggatggcttccctggagccgaccccgacgatgtgctcacggtcaccgagagtagccgcggcctcaacctcgagtgcctgtgggagaaggcccggcgtggggccggccggggtgggggggcacctgcctggcagccggcgtcggcccccccggccccccacgccaacccctccaaccctttctacgaggcgctgtccacgcccagcgtgctgcctgtcatcagcgcccgcagcccctccgtgagcagcgagtactacatccgcttggaggagcacggctcccctcctgagcccctcttccccaacgactgggaccccctggacccaggagtgcccgcccctcaggccccccaggccccctccgaggtcccccagctggtgtccgagacctgggcctcccccctcttccctgcgccccggcccttcccagcccagtcctcagcgtcaggcagcttcctgctgagcggctgggaccccgagggccggggcgccggggagaccctggcgggagaccctgccgaggtcttgggggagcgggggaccgccccgtgggtggaagaagaagaggaggaggaggagggcagctccccaggggaagacagcagcagccttggaggtggcccaagccgccggggtcccctaccctgtcccctgtgcagccgcgagggggcctgctcctgcctgccactggagcggggggacgccgtagcaggctggggaggccaccctgctcttggctgcccccacccccccgaggacgactcctcgctgcgggcagagcggggctccctggccgacttgcccatggcccccccgcctcggccccccccgagtttctggaccccctcatgggggcggcggcgccccagtaccccgggcgggggccacctcccgctcccccccccccgccgccacctcctcgggcccccgcggacccggccgcgtcccccgaccccccttcggccgtggccagtcccggttcaggcctctcgtcgccgggccccaagccgggggacagcggctacgagaccgagacccctttttccccagagggagccttcccaggtgggggggcggccgaggaggaaggggtccctcggccgcgggctccccccgagccacccgacccaggagcgccccggccacctccagacccgggtccgctcccactcccggggccccgggagaagccgaccttcgtggttcaagtgagcacggaacagctgctgatgtccctgcgggaggatgtgacaaggaacctcctgggggagaagggggcgacagcccgggagacaggacccaggaaggcggggagaggccccgggaacagagagaaagtcccgggcctgaacagggacccgacagtcctgggcaacgggaaacaagccccaagcctgagcctcccagtgaacggggtgacagtgctggagaacggggaccagagagccccaggcatcgaggagaaggcggcggagaatggggccctggggtcccccgagagagaagagaaagtgctggagaatggggagctgacacccccaaggagggaggagaaagcgctggagaatggggagctgaggtccccagaggccggggagaaggtgctggtgaatgggggcctgacacccccaaagagcgaggacaaggtgtcagagaatgggggcctgagattccccaggaacacggagaggccaccagagactgggccttggagagccccagggccctgggagaagacgcccgagagttggggtccagcccccacgatcggggagccagccccagagacctctctggagagagcccctgcacccagcgcagtggtctcctcccggaacggcggggagacagcccctggcccccttggcccagcccccaagaacgggacgctggaacccgggaccgagaggagaccaaatgaggcaggaatccccccgcccctccatagagagccgcctttctcggaactgaactgaactcttttgggcctggagcccctcgacacagcggaggtccctcctcacccactcctggcccaagacaggggccgcaggcttcggggacccggaccccccatttcgcgtctcccctttccctccccagcccggcccctggaggggcctctggttcaaaccttcgcgtggcattttcacattatttaaaaaagacaaaaacaactttttggaggaaaaaaaaaaaaaaaaaaacaaaaaaaaaaaaaaaaaaaccaaaaaacaaaaaaaaaaaacgcggcgccccccaccaacacaacccccccgcccgggccccaaccacgcccagccccgcacgccaccacgcctctcttcgggcacacaacaagcgcgcgccccccacatacagagcgaggcccgtactcagagaggcagcacgccggcaccaccgaccacacacccaccgcccggctaacgcagcagacaaaaaccctgcccaccacgacgaccatcaaaacagacgagagaacccacctacactacagcgaagagcgaaaaaccacactcgcagcacacacacccaccacaccgaccaaccacacaacacgccgcaaccagacgggggcacctaacaccacgaccacgacccgcacgaggtccaatccacggcgcgggcaaacacacaagcccggcagactcacgtggactggacggcacacagaacgacactgtctcggccccaggcgcacgttactactacatgccagcacgatcactttccaccacacgcacgccctagacctcacataacaatccccctcacgcttgactacgacagatgcttttcggcgatcactcccagttcagactcaactaagtccgcatcacgtatcacgacgctgcctacctgacgctcgtcactcagcgcgcacgactccccatgcaccctgaccaccgccgcgtctactcccatagctcccacaatggctcaagccaaaagtagccaggtatcctccgcaccgtcgtcctattgagcagcaacactc

SEQ ID NO: 345339 - DNA, 363 bp, Homo sapiens
gctgggaccccagcccagccctgtgcccacagatggattcgccctgggccgggctcctctggctcctccctacgctgtggtcctcatttcctgctccggcctgctggccttcatcttcctcctcctcacctgtctgtgctgcaaacggggcgatgtcggcttcaaggtgaggtgcatgaggggattcaacttggggaggaagactccagcaaggcctttaccccctacacaggtggttggtggggagaagggggcagtaaatccgagagcaccttccagcttgaagctatggcaagatctggagccttgggatggggaaatgggggatggaaattgggctgggactgggagacagttacaaaa

SEQ ID NO: 345340 - DNA, 5752 bp, Homo sapiens
gtctgcgtaaccgcacgggaaacccgccaccacctccacctccctgccatcctcgacaagatgcctgcccccggcgccctcatcctccttgcggccgtctccgcctccggctgcctggcgtccccggcccaccccgatggattcgccctgggccgggctcctctggctcctccctacgctgtggtcctcatttcctgctccggcctgctggccttcatcttcctcctcctcacctgtctgtgctgcaaacggggcgatgtcggcttcaaggaatttgagaaccctgaaggggaggactgctccggggagtacactccccctgcggaggagacctcctcctcacagtcgctgcctgatgtctacattctcccgctggctgaggtctccctgccaatgcctgccccgcagccttcacactcagacatgaccacccccctgggccttagccggcagcacctgagctacctgcaggagattgggagtggctggtttgggaaggtgatcctgggagagattttctccgactacacccccgcccaggtggtggtgaaggagctccgagccagcgcggggcccctggagcaacgcaagttcatctcggaagcacagccgtacaggagcctgcagcaccccaatgtcctccagtgcctgggtctgtgcgtggagacgctgccgtttctgctgattatggagttctgtcaactgggggacctgaagcgttacctccgagcccagcggccccccgagggcctgtcccctgagctaccccctcgagacctgcggacgctgcagaggatgggcctggagatcgcccgcgggctggcgcacctgcattcccacaactacgtgcacagcgacctggccctgcgcaactgcctgctgacctctgacctgaccgtgcgcatcggagactacgggctggcccacagcaactacaaggaggactactacctgaccccagagcgcctgtggatcccactgcgctgggcggcgcccgagctcctcggggagctccacgggaccttcatggtggtggaccagagccgcgagagcaacatctggtccctgggggtgaccctgtgggagctgtttgagtttggggcccagccctaccgccacctgtcagacgaggaggtcctcgccttcgtggtccgccagcagcatgtgaagctggcccggccgaggctcaagctgccttacgcggactactggtatgacattcttcagtcctgctggcggccacctgcccagcgcccttcagcctctgatctccaattgcagctcacctacttgctctccgagcggcctccccggcccccaccgccgccacccccaccccgagacggtcccttcccctggccctggccccctgcacacagtgcgccccgcccggggaccctctcctcaccgttccccctactggatggcttccctggagccgaccccgacgatgtgctcacggtcaccgagagtagccgcggcctcaacctcgagtgcctgtgggagaaggcccggcgtggggccggccggggtgggggggcacctgcctggcagccggcgtcggcccccccggccccccacgccaacccctccaaccctttctacgaggcgctgtccacgcccagcgtgctgcctgtcatcagcgcccgcagcccctccgtgagcagcgagtactacatccgcttggaggagcacggctcccctcctgagcccctcttccccaacgactgggaccccctggacccaggagtgcccgcccctcaggccccccaggccccctccgaggtcccccagctggtgtccgagacctgggcctcccccctcttccctgcgccccggcccttcccagcccagtcctcagcgtcaggcagcttcctgctgagcggctgggaccccgagggccggggcgccggggagaccctggcgggagaccctgccgaggtcttgggggagcgggggaccgccccgtgggtggaagaagaagaggaggaggaggagggcagctccccaggggaagacagcagcagccttggaggtggcccaagccgccggggtcccctaccctgtcccctgtgcagccgcgagggggcctgctcctgcctgccactggagcggggggacgccgtagcaggctggggaggccaccctgctcttggctgcccccacccccccgaggacgactcctcgctgcgggcagagcggggctccctggccgacttgcccatggcccccccgcctcggccccccccgagtttctggaccccctcatgggggcggcggcgccccagtaccccgggcgggggccacctcccgctcccccccccccgccgccacctcctcgggcccccgcggacccggccgcgtcccccgaccccccttcggccgtggccagtcccggttcaggcctctcgtcgccgggccccaagccgggggacagcggctacgagaccgagacccctttttccccagagggagccttcccaggtgggggggcggccgaggaggaaggggtccctcggccgcgggctccccccgagccacccgacccaggagcgccccggccacctccagacccgggtccgctcccactcccggggccccgggagaagccgaccttcgtggttcaagtgagcacggaacagctgctgatgtccctgcgggaggatgtgacaaggaacctcctgggggagaagggggcgacagcccgggagacaggacccaggaaggcggggagaggccccgggaacagagagaaagtcccgggcctgaacagggacccgacagtcctgggcaacgggaaacaagccccaagcctgagcctcccagtgaacggggtgacagtgctggagaacggggaccagagagccccaggcatcgaggagaaggcggcggagaatggggccctggggtcccccgagagagaagagaaagtgctggagaatggggagctgacacccccaaggagggaggagaaagcgctggagaatggggagctgaggtccccagaggccggggagaaggtgctggtgaatgggggcctgacacccccaaagagcgaggacaaggtgtcagagaatgggggcctgagattccccaggaacacggagaggccaccagagactgggccttggagagccccagggccctgggagaagacgcccgagagttggggtccagcccccacgatcggggagccagccccagagacctctctggagagagcccctgcacccagcgcagtggtctcctcccggaacggcggggagacagcccctggcccccttggcccagcccccaagaacgggacgctggaacccgggaccgagaggagagcccccgagactgggggggcgccgagagccccaggggctgggaggctggacctcgggagtgggggccgagccccagtgggcacggggacggcccccggcggcggccccggaagcggcgtggacgcaaaggccggatgggtagacaacacgaggccgcagccaccgccgccaccgctgccaccgccaccggaggcacagccgaggaggctggagccagcgcccccgagagccaggccggaggtggcccccgagggagagcccggggccccagacagcagggccggcggagacacggcactcagcggagacggggacccccccaagcccgagaggaagggccccgagatgccacgactattcttggacttgggaccccctcaggggaacagcgagcagatcaaagccaggctctcccggctctcgctggcgctgccgccgctcacgctcacgccattcccggggccgggcccgcggcggcccccgtgggagggcgcggacgccggggcggctggcggggaggccggcggggcgggagcgccggggccggcggaggaggacggggaggacgaggacgaggacgaggaggaggacgaggaggcggcggcgccgggcgcggcggcggggccgcggggccccgggagggcgcgagcagccccggtgcccgtcgtggtgagcagcgccgacgcggacgcggcccgcccgctgcgggggctgctcaagtctccgcgcggggccgacgagccagaggacagcgagctggagaggaagcgcaagatggtctccttccacggggacgtgaccgtctacctcttcgaccaggagacgccaaccaacgagctgagcgtccaggccccccccgagggggacacggacccgtcaacgcctccagcgcccccgacacctccccaccccgccacccccggagatgggtttcccagcaacgacagcggctttggaggcagtttcgagtgggcggaggatttccccctcctcccccctccaggccccccgctgtgcttctcccgcttctccgtctcgcctgcgctggagaccccggggccacccgcccgggcccccgacgcccggcccgcaggccccgtggagaattgattccccgaagacccgaccccgctgcaccctcagaagaggggttgagaatggaatcctctgtggatgacggcgccactgccaccaccgcagacgccgcctctggggaggcccccgaggctgggccctccccctcccactcccctaccatgtgccaaacgggaggccccgggcccccgccccccagccccccagatggctcccctgacccccctgaccccctcggagccaaatgaggcaggaatccccccgcccctccatagagagccgcctttctcggaactgaactgaactcttttgggcctggagcccctcgacacagcggaggtccctcctcacccactcctggcccaagacaggggccgcaggcttcggggacccggaccccccatttcgcgtctcccctttccctccccagcccggcccctggaggggcctctggttcaaaccttcgcgtggcattttcacattatttaaaaaagacaaaaacaactttttggaggaaaaaaaaaaaaaaaaaaacaaaaaaaaaaaaaaaaaaaccaaaaaacaaaaaaaaaaaacgcggcgccccccaccaacacaacccccccgcccgggccccaaccacgcccagccccgcacgccaccacgcctctcttcgggcacacaacaagcgcgcgccccccacatacagagcgaggcccgtactcagagaggcagcacgccggcaccaccgaccacacacccaccgcccggctaacgcagcagacaaaaaccctgcccaccacgacgaccatcaaaacagacgagagaacccacctacactacagcgaagagcgaaaaaccacactcgcagcacacacacccaccacaccgaccaaccacacaacacgccgcaaccagacgggggcacctaacaccacgaccacgacccgcacgaggtccaatccacggcgcgggcaaacacacaagcccggcagactcacgtggactggacggcacacagaacgacactgtctcggccccaggcgcacgttactactacatgccagcacgatcactttccaccacacgcacgccctagacctcacataacaatccccctcacgcttgactacgacagatgcttttcggcgatcactcccagttcagactcaactaagtccgcatcacgtatcacgacgctgcctacctgacgctcgtcactcagcgcgcacgactccccatgcaccctgaccaccgccgcgtctactcccatagctcccacaatggctcaagccaaaagtagccaggtatcctccgcaccgtcgtcctattgagcagcaacactc

SEQ ID NO: 345341 - DNA, 548 bp, Homo sapiens
gtctgcgtaaccgcacgggaaacccgccaccacctccacctccctgccatcctcgacaagatgcctgcccccggcgccctcatcctccttgcggccgtctccgcctccggctgcctggcgtccccggcccaccccgatggattcgccctgggccgggctcctctggctcctccctacgctgtggtcctcatttcctgctccggcctgctggccttcatcttcctcctcctcacctgtctgtgctgcaaacggggcgatgtcggcttcaaggaatttgagaaccctgaaggggaggactgctccggggagtacactccccctgcggaggagacctcctcctcacagtcgctgcctgatgtctacattctcccgctggctgaggtctccctgccaatgcctgccccgcagccttcacactcagacatgaccacccccctgggccttagccggcagcacctgagctacctgcaggagattgggagtggctggtttgggaagtcagcgcctccctcctcactccattgaccactccgccgcgccacccggct

SEQ ID NO: 345342 - DNA, 4562 bp, Homo sapiens
gccaaaataaaagactccatgcctttgctggagaagaatgagccgaagatgagcgaagccaaaaattatctaagcagtatccttaaccatgggaggctctcgccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaaggcctctctctggaacgcctacccaactccatcgcctcccgcttccgcctgacagagagggaggaagaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatgttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcctctgcagctgcagccctcgttctcttggctgggccaagagggccttcctggatttctttgttggtgccttgggaaacagtctgacttgaaccctaagtgcctttggagagttttgtggtgaccagacttgctccccaagagctgggcagcggggagcctcacagctgtccttcaccctcacccatgcctctggcttggggtctgggtggggggttctcactccccactctcagcacagtacagacttctggatctctctcaggtcttgcccagggcggtcacaatgtgaagaaactgcgggcaagtgggaagactatgagatttctgggttcccttctcagacttggagttagtagatgattcctgcattgcccctgcttgccctctgagaccagctgggccccaccttgctctttccccctgctaccaagtgcctttggggcctctggggtctgaccaggggtactgagcaccggccctaacacttccatctccacccaccccatctccctggcgatgtgctccagcccaagcagcctccgtaggctttagatcctgtggttgccagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttccccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatatatataaaatagagatctattttttttctggaattctgttagaaaagtaaagaaaaagcaaatgctgttggtttatctcagggtgcccaaagtggttatagtcaatttttggtactaggaaaggcacccaatgcatttcctgacttttaagcatttccttgttggaagcagcagagggccaggccaagttgctgacagtgactttgcaggttgaataaagaaacccttggaggggaagcaggcttgtctgaagcagcatgtatattcactgggcatgtagctcccacaccagccttgagccaggccctggacaggaggggctgttgcaggatgagggaggccagagaaggcatcgaagccaagacctgggcccagctggggagggatgtgggaaaggaaggatgggagggaggaccctctgggaaaatgtggatttgagctggtgagagtgttgctaaggctgggctaaagcctggagagggtaggaggaggcaagaggggtccaggcagggctgatcctggcctctgacctgtccagggcgacccctgaagcccctgctgcctctgggcattgctgggagaggccaaggcaggactcacgtctgaacagagatcccctcgggcattgctgatgggccaccttcagctgcagggaagaagcctaggagaggaggcatgggagggacctgggccttgttcagattggccacctctgctgagaagtccataccagtacacccctaataagttatgccacataccaacgtactgtggatattataacctgcattaaaacaactctaaagaacgctgctcatttacacagaagc

SEQ ID NO: 345343 - DNA, 4683 bp, Homo sapiens
tagggactcataggagaattttattgagaaccacaatgtaggctgcagaccatgggtgagagcggggagctgtcggcatgtgcttgagcatcaaagaaggctttctggaggaggaggggagttctgagcaaggtctgaggcaaacaaggtccaggttcagtgggggtgttcaccccaaggtaactttggggcaggcgctggtaacatgtccttgtcatttcagccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaaggcctctctctggaacgcctacccaactccatcgcctcccgcttccgcctgacagagagggaggaagaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatgttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcctctgcagctgcagccctcgttctcttggctgggccaagagggccttcctggatttctttgttggtgccttgggaaacagtctgacttgaaccctaagtgcctttggagagttttgtggtgaccagacttgctccccaagagctgggcagcggggagcctcacagctgtccttcaccctcacccatgcctctggcttggggtctgggtggggggttctcactccccactctcagcacagtacagacttctggatctctctcaggtcttgcccagggcggtcacaatgtgaagaaactgcgggcaagtgggaagactatgagatttctgggttcccttctcagacttggagttagtagatgattcctgcattgcccctgcttgccctctgagaccagctgggccccaccttgctctttccccctgctaccaagtgcctttggggcctctggggtctgaccaggggtactgagcaccggccctaacacttccatctccacccaccccatctccctggcgatgtgctccagcccaagcagcctccgtaggctttagatcctgtggttgccagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttccccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatatatataaaatagagatctattttttttctggaattctgttagaaaagtaaagaaaaagcaaatgctgttggtttatctcagggtgcccaaagtggttatagtcaatttttggtactaggaaaggcacccaatgcatttcctgacttttaagcatttccttgttggaagcagcagagggccaggccaagttgctgacagtgactttgcaggttgaataaagaaacccttggaggggaagcaggcttgtctgaagcagcatgtatattcactgggcatgtagctcccacaccagccttgagccaggccctggacaggaggggctgttgcaggatgagggaggccagagaaggcatcgaagccaagacctgggcccagctggggagggatgtgggaaaggaaggatgggagggaggaccctctgggaaaatgtggatttgagctggtgagagtgttgctaaggctgggctaaagcctggagagggtaggaggaggcaagaggggtccaggcagggctgatcctggcctctgacctgtccagggcgacccctgaagcccctgctgcctctgggcattgctgggagaggccaaggcaggactcacgtctgaacagagatcccctcgggcattgctgatgggccaccttcagctgcagggaagaagcctaggagaggaggcatgggagggacctgggccttgttcagattggccacctctgctgagaagtccataccagtacacccctaataagttatgccacataccaacgtactgtggatattataacctgcattaaaacaactctaaagaacgctgctcatttacacagaagc

SEQ ID NO: 345344 - DNA, 3968 bp, Homo sapiens
gccaaaataaaagactccatgcctttgctggagaagaatgagccgaagatgagcgaagccaaaaattatctaagcagtatccttaaccatgggaggctctcgccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaaggcctctctctggaacgcctacccaactccatcgcctcccgcttccgcctgacagagagggaggaagaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatgttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcctctgcagctgcagccctcgttctcttggctgggccaagagggccttcctggatttctttgttggtgccttgggaaacagtctgacttgaaccctaagtgcctttggagagttttgtggtgaccagacttgctccccaagagctgggcagcggggagcctcacagctgtccttcaccctcacccatgcctctggcttggggtctgggtggggggttctcactccccactctcagcacagtacagacttctggatctctctcaggtcttgcccagggcggtcacaatgtgaagaaactgcgggcaagtgggaagactatgagatttctgggttcccttctcagacttggagttagtagatgattcctgcattgcccctgcttgccctctgagaccagctgggccccaccttgctctttccccctgctaccaagtgcctttggggcctctggggtctgaccaggggtactgagcaccggccctaacacttccatctccacccaccccatctccctggcgatgtgctccagcccaagcagcctccgtaggctttagatcctgtggttgccagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttccccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatatatataaaatagagatctattttttttctggaattctgttagaaaagtaaagaaaaagcaaatgctgttggtttatctcagggtgcccaaagtggttatagtcaatttttggtactaggaaaggcacccaatgcatttcctgacttttaagcatttccttgttggaagcagcagagggccaggccaagttgctgacagtgactttgcaggttgaataaagaaacccttggagggga

SEQ ID NO: 345345 - DNA, 3615 bp, Homo sapiens
gccaaaataaaagactccatgcctttgctggagaagaatgagccgaagatgagcgaagccaaaaattatctaagcagtatccttaaccatgggaggctctcgccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaaggcctctctctggaacgcctacccaactccatcgcctcccgcttccgcctgacagagagggaggaagaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatgttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcctctgcagctgcagccctcgttctcttggctgggccaagagggccttcctggatttctttgttggtgccttgggaaacagtctgacttgaaccctaagtgcctttggagagttttgtggtgaccagacttgctccccaagagctgggcagcggggagcctcacagctgtccttcaccctcacccatgcctctggcttggggtctgggtggggggttctcactccccactctcagcacagtacagacttctggatctctctcaggtcttgcccagggcggtcacaatgtgaagaaactgcgggcaagtgggaagactatgagatttctgggttcccttctcagacttggagttagtagatgattcctgcattgcccctgcttgccctctgagaccagctgggccccaccttgctctttccccctgctaccaagtgcctttggggcctctggggtctgaccaggggtactgagcaccggccctaacacttccatctccacccaccccatctccctggcgatgtgctccagcccaagcagcctccgtaggctttagatcctgtggttgccagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttccccaaggagtcagtcccccaggcctatcaggggatccttttgtatctgcactttgggttttagtttcaaagctccactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatata

SEQ ID NO: 345346 - DNA, 917 bp, Homo sapiens
gccaaaataaaagactccatgcctttgctggagaagaatgagccgaagatgagcgaagccaaaaattatctaagcagtatccttaaccatgggaggctctcgccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaaggcctctctctggaacgcctacccaactccatcgcctcccgcttccgcctgacagagagggaggaagaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggtcaataacctctgcgctgggacgttctacatcgtccctgcggccttt

SEQ ID NO: 345347 - DNA, 1216 bp, Homo sapiens
ttaaataaaacatgttattaaaattaatttcaccttttacctttttcagtgtgactaaaaaaaatcttagtagaaatttttaaattacacatgtggttcacatttgtggcttacatcatatttttttggacagtgcttggttgacttaatatgtgcctggccctttgggctccttgggtcagggggctctcaggaaaataaaacctcagtgaacctgtgacctagttagaaacaggcaaacatgcagagttggctagggacagaagagctccataacagggcaagcccatttaagtccacgtgtatttatcaagcacctactgagtacaagacactgagggaggtagaggacccacctctccctcccagaaggagtatggtcacaactttctctggactttgctgctcaaaatgtggtccacccaccagcagtgtaggcatcattggggagctggttagaaatgcaattaagaattagaatctgtgttttaacaagctctcctgggtgattcatatgtgcatccaagtttgaggctgtggctgtgttagattacaatgtatcctgaactataatagtggcatgggtatgtcattagaaactcaaaagaggagggggagggggtaaaaaaaaactcaaagaggaagtgatccctccctccctcccttccttccttgcttccttcccctctgtctctctctttctttctgtctttctgtctgtctttattttcttcagggtctcgctgtgttactcaggctggtctccaactcctgggctcaagcgatcctcctacttcagcctcccgaagcgttgggattacaggagtgaggcactgcgcccagctgatttttaaagagctattccaaagtaatatattcacttccttaaaccttttattccaacgtactgtgtgcaaggcattgtgttgtgcactctgaaggcaatcaagacgaatccagcatggaccctgccctcaaggaggttgcaggtctcttgggaagataagtcctatcagcaagtaaatagccttcctccaaggtagaccgtgataggagtgctatccacgaggaagcaagtctgagggggatgctctttggggataagcagagagcagactctgagtaatggcagtactagaattggatccttctggggctggatctagacaaggttgtaaaggtactttggggctagtaagggcagactggaacacca

SEQ ID NO: 345348 - DNA, 316 bp, Homo sapiens
gcagcaaagatggggagaaactgaggcacacagagaaagcaagcggtccaggggcatggcagaggctgctgccctcatggcactctgctttctgcgagttagggaggtgagcatgtggagccgccctggtggggcaggatccccaggtgaaagtgggcccttgctggggtgtgctgatggccactctccgtccccacagcctgatgttcaccaaggtgaagctggagcaggtgctgaaaggcccagaggaagccctcgtgacctgcagacaagtgctgaggctgtggcagaccctgtacagcttctcccagctggg

SEQ ID NO: 345349 - DNA, 4358 bp, Homo sapiens
tctttccagcatgcctccggcttcttgggggaacacagtcccggtggtcagaggtcctgcaggggaggcctctctctggaacgcctacccaactccatcgcctcccgcttccgcctgacagagagggaggaagaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatgttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcctctgcagctgcagccctcgttctcttggctgggccaagagggccttcctggatttctttgttggtgccttgggaaacagtctgacttgaaccctaagtgcctttggagagttttgtggtgaccagacttgctccccaagagctgggcagcggggagcctcacagctgtccttcaccctcacccatgcctctggcttggggtctgggtggggggttctcactccccactctcagcacagtacagacttctggatctctctcaggtcttgcccagggcggtcacaatgtgaagaaactgcgggcaagtgggaagactatgagatttctgggttcccttctcagacttggagttagtagatgattcctgcattgcccctgcttgccctctgagaccagctgggccccaccttgctctttccccctgctaccaagtgcctttggggcctctggggtctgaccaggggtactgagcaccggccctaacacttccatctccacccaccccatctccctggcgatgtgctccagcccaagcagcctccgtaggctttagatcctgtggttgccagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttccccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatatatataaaatagagatctattttttttctggaattctgttagaaaagtaaagaaaaagcaaatgctgttggtttatctcagggtgcccaaagtggttatagtcaatttttggtactaggaaaggcacccaatgcatttcctgacttttaagcatttccttgttggaagcagcagagggccaggccaagttgctgacagtgactttgcaggttgaataaagaaacccttggaggggaagcaggcttgtctgaagcagcatgtatattcactgggcatgtagctcccacaccagccttgagccaggccctggacaggaggggctgttgcaggatgagggaggccagagaaggcatcgaagccaagacctgggcccagctggggagggatgtgggaaaggaaggatgggagggaggaccctctgggaaaatgtggatttgagctggtgagagtgttgctaaggctgggctaaagcctggagagggtaggaggaggcaagaggggtccaggcagggctgatcctggcctctgacctgtccagggcgacccctgaagcccctgctgcctctgggcattgctgggagaggccaaggcaggactcacgtctgaacagagatcccctcgggcattgctgatgggccaccttcagctgcagggaagaagcctaggagaggaggcatgggagggacctgggccttgttcagattggccacctctgctgagaagtccataccagtacacccctaataagttatgccacataccaacgtactgtggatattataacctgcattaaaacaactctaaagaacgctgctcatttacacagaagc

SEQ ID NO: 345350 - DNA, 5328 bp, Homo sapiens
ttaaataaaacatgttattaaaattaatttcaccttttacctttttcagtgtgactaaaaaaaatcttagtagaaatttttaaattacacatgtggttcacatttgtggcttacatcatatttttttggacagtgcttggttgacttaatatgtgcctggccctttgggctccttgggtcagggggctctcaggaaaataaaacctcagtgaacctgtgacctagttagaaacaggcaaacatgcagagttggctagggacagaagagctccataacagggcaagcccatttaagtccacgtgtatttatcaagcacctactgagtacaagacactgagggaggtagaggacccacctctccctcccagaaggagtatggtcacaactttctctggactttgctgctcaaaatgtggtccacccaccagcagtgtaggcatcattggggagctggttagaaatgcaattaagaattagaatctgtgttttaacaagctctcctgggtgattcatatgtgcatccaagtttgaggctgtggctgtgttagattacaatgtatcctgaactataatagtggcatgggtatgtcattagaaactcaaaagaggagggggagggggtaaaaaaaaactcaaagaggaagtgatccctccctccctcccttccttccttgcttccttcccctctgtctctctctttctttctgtctttctgtctgtctttattttcttcagggtctcgctgtgttactcaggctggtctccaactcctgggctcaagcgatcctcctacttcagcctcccgaagcgttgggattacaggagtgaggcactgcgcccagctgatttttaaagagctattccaaaccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaaggcctctctctggaacgcctacccaactccatcgcctcccgcttccgcctgacagagagggaggaagaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatgttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcctctgcagctgcagccctcgttctcttggctgggccaagagggccttcctggatttctttgttggtgccttgggaaacagtctgacttgaaccctaagtgcctttggagagttttgtggtgaccagacttgctccccaagagctgggcagcggggagcctcacagctgtccttcaccctcacccatgcctctggcttggggtctgggtggggggttctcactccccactctcagcacagtacagacttctggatctctctcaggtcttgcccagggcggtcacaatgtgaagaaactgcgggcaagtgggaagactatgagatttctgggttcccttctcagacttggagttagtagatgattcctgcattgcccctgcttgccctctgagaccagctgggccccaccttgctctttccccctgctaccaagtgcctttggggcctctggggtctgaccaggggtactgagcaccggccctaacacttccatctccacccaccccatctccctggcgatgtgctccagcccaagcagcctccgtaggctttagatcctgtggttgccagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttccccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatatatataaaatagagatctattttttttctggaattctgttagaaaagtaaagaaaaagcaaatgctgttggtttatctcagggtgcccaaagtggttatagtcaatttttggtactaggaaaggcacccaatgcatttcctgacttttaagcatttccttgttggaagcagcagagggccaggccaagttgctgacagtgactttgcaggttgaataaagaaacccttggaggggaagcaggcttgtctgaagcagcatgtatattcactgggcatgtagctcccacaccagccttgagccaggccctggacaggaggggctgttgcaggatgagggaggccagagaaggcatcgaagccaagacctgggcccagctggggagggatgtgggaaaggaaggatgggagggaggaccctctgggaaaatgtggatttgagctggtgagagtgttgctaaggctgggctaaagcctggagagggtaggaggaggcaagaggggtccaggcagggctgatcctggcctctgacctgtccagggcgacccctgaagcccctgctgcctctgggcattgctgggagaggccaaggcaggactcacgtctgaacagagatcccctcgggcattgctgatgggccaccttcagctgcagggaagaagcctaggagaggaggcatgggagggacctgggccttgttcagattggccacctctgctgagaagtccataccagtacacccctaataagttatgccacataccaacgtactgtggatattataacctgcattaaaacaactctaaagaacgctgctcatttacacagaagc

SEQ ID NO: 345351 - DNA, 4445 bp, Homo sapiens
gccaaaataaaagactccatgcctttgctggagaagaatgagccgaagatgagcgaagccaaaaattatctaagcagtatccttaaccatgggaggctctcgccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaaggcctctctctggaacgcctacccaactccatcgcctcccgcttccgcctgacagagagggaggaagaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaaaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcctctgcagctgcagccctcgttctcttggctgggccaagagggccttcctggatttctttgttggtgccttgggaaacagtctgacttgaaccctaagtgcctttggagagttttgtggtgaccagacttgctccccaagagctgggcagcggggagcctcacagctgtccttcaccctcacccatgcctctggcttggggtctgggtggggggttctcactccccactctcagcacagtacagacttctggatctctctcaggtcttgcccagggcggtcacaatgtgaagaaactgcgggcaagtgggaagactatgagatttctgggttcccttctcagacttggagttagtagatgattcctgcattgcccctgcttgccctctgagaccagctgggccccaccttgctctttccccctgctaccaagtgcctttggggcctctggggtctgaccaggggtactgagcaccggccctaacacttccatctccacccaccccatctccctggcgatgtgctccagcccaagcagcctccgtaggctttagatcctgtggttgccagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttccccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatatatataaaatagagatctattttttttctggaattctgttagaaaagtaaagaaaaagcaaatgctgttggtttatctcagggtgcccaaagtggttatagtcaatttttggtactaggaaaggcacccaatgcatttcctgacttttaagcatttccttgttggaagcagcagagggccaggccaagttgctgacagtgactttgcaggttgaataaagaaacccttggaggggaagcaggcttgtctgaagcagcatgtatattcactgggcatgtagctcccacaccagccttgagccaggccctggacaggaggggctgttgcaggatgagggaggccagagaaggcatcgaagccaagacctgggcccagctggggagggatgtgggaaaggaaggatgggagggaggaccctctgggaaaatgtggatttgagctggtgagagtgttgctaaggctgggctaaagcctggagagggtaggaggaggcaagaggggtccaggcagggctgatcctggcctctgacctgtccagggcgacccctgaagcccctgctgcctctgggcattgctgggagaggccaaggcaggactcacgtctgaacagagatcccctcgggcattgctgatgggccaccttcagctgcagggaagaagcctaggagaggaggcatgggagggacctgggccttgttcagattggccacctctgctgagaagtccataccagtacacccctaataagttatgccacataccaacgtactgtggatattataacctgcattaaaacaactctaaagaacgctgctcatttacacagaagc

SEQ ID NO: 345352 - DNA, 3734 bp, Homo sapiens
gccaaaataaaagactccatgcctttgctggagaagaatgagccgaagatgagcgaagccaaaaattatctaagcagtatccttaaccatgggaggctctcgccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaaggcctctctctggaacgcctacccaactccatcgcctcccgcttccgcctgacagagagggaggaagaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatgttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcctctgcagctgcagccctcgttctcttggctgggccaagagggccttcctggatttctttgttggtgccttgggaaacagtctgacttgaaccctaagtgcctttggagagttttgtggtgaccagacttgctccccaagagctgggcagcggggagcctcacagctgtccttcaccctcacccatgcctctggcttggggtctgggtggggggttctcactccccactctcagcacagtacagacttctggatctctctcaggtcttgcccagggcggtcacaatgtgaagaaactgcgggcaagtgggaagactatgagatttctgggttcccttctcagacttggagttagtagatgattcctgcattgcccctgcttgccctctgagaccagctgggccccaccttgctctttccccctgctaccaagtgcctttggggcctctggggtctgaccaggggtactgagcaccggccctaacacttccatctccacccaccccatctccctggcgatgtgctccagcccaagcagcctccgtaggctttagatcctgtggttgccagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttccccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatata

SEQ ID NO: 345353 - DNA, 2796 bp, Homo sapiens
agcttgtgtaccccccgagtatgggatatcgtgacccacgccgtcgcggacgcgtggggagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcctctgcagctgcagccctcgttctcttggctgggccaagagggccttcctggatttctttgttggtgccttgggaaacagtctgacttgaaccctaagtgcctttggagagttttgtggtgaccagacttgctccccaagagctgggcagcggggagcctcacagctgtccttcaccctcacccatgcctctggcttggggtctgggtggggggttctcactccccactctcagcacagtacagacttctggatctctctcaggtcttgcccagggcggtcacaatgtgaagaaactgcgggcaagtgggaagactatgagatttctgggttcccttctcagacttggagttagtagatgattcctgcattgcccctgcttgccctctgagaccagctgggccccaccttgctctttccccctgctaccaagtgcctttggggcctctggggtctgaccaggggtactgagcaccggccctaacacttccatctccacccaccccatctccctggcgatgtgctccagcccaagcagcctccgtaggctttagatcctgtggttgccagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttccccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatatatataaaatagagatctattttttttctggaattctgttagaaaagtaaagaaaaagcaaatgctgttggtttatctcagggtgcccaaagtggttatagtcaatttttggtactaggaaaggcacccaatgcatttcctgacttttaagcatttccttgttggaagcagcagagggccaggccaagttgctgacagtgactttgcaggttgaataaagaaacccttggaggggaagcaggcttgtctgaagcagcatgtatattcactgggcatgtagctcccacaccagccttgagccaggccctggacaggaggggctgttgcaggatgagggaggccagagaaggcatcgaagccaagacctgggcccagctggggagggatgtgggaaaggaaggatgggagggaggaccctctgggaaaatgtggatttgagctggtgagagtgttgctaaggctgggctaaagcctggagagggtaggaggaggcaagaggggtccaggcagggctgatcctggcctctgacctgtccagggcgacccctgaagcccctgctgcctctgggcattgctgggagaggccaaggcaggactcacgtctgaacagagatcccctcgggcattgctgatgggccaccttcagctgcagggaagaagcctaggagaggaggcatgggagggacctgggccttgttcagattggccacctctgctgagaagtccataccagtacacccctaataagttatgccacataccaacgtactgtggatattataacctgcattaaaacaactctaaagaacgctgctcatttacacagaagc

SEQ ID NO: 345354 - DNA, 2675 bp, Homo sapiens
gccaaaataaaagactccatgcctttgctggagaagaatgagccgaagatgagcgaagccaaaaattatctaagcagtatccttaaccatgggaggctctcgccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaaggcctctctctggaacgcctacccaactccatcgcctcccgcttccgcctgacagagagggaggaagaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatgttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacagagatcccctcgggcattgctgatgggccaccttcagctgcagggaagaagcctaggagaggaggcatgggagggacctgggccttgttcagattggccacctctgctgagaagtccataccagtacacccctaataagttatgccacataccaacgtactgtggatattataacctgcattaaaacaactctaaagaacgctgctcatttacacagaagc

SEQ ID NO: 345355 - DNA, 845 bp, Homo sapiens
gtctttttttgcccagtttggcccctcataatgctcctacaaataataccgtcacaacaggtcttattgatggggctgtggtcagtggcattggttctggtgaaagattcttccctcctccctccggcttaagttactctagctggttttgtattgaacattttagttctcctccaaataaccaccctgtcagacttcttactgttgtgcgccgagcaaattcttctgagcaacattacgtgtgccttgcaatagttctatcagcaaaagaccgatctctgattgtttccaccaaagaggaactcctccaaaattatgttgatgattttagtgaagagtcctcattttatgaaattctcccatgctgtgctcgctttcgatgtggagagcttatcattgagggacagtggcatcatttggtcctggtaatgagcaaaggcatgttgaaaaacagtactgcagccctttatattgatggacagcttgttaacactgtaaagccttcattaatgtccacaagactcgttggaattttgggtaccttttgggggtaccgtgcctttccctttcgtaagtttcaaccaaggtgaaaggttttaattaacttgaacgaaatggaatccccattggtttgcccttaaaggtaaggtttaaaacaatgtgaattaaatggtttaaaaaaaccgtaagtaattgcctttaaaaaatggtgtgttgcgaaatttggtgtaaaaattaaccttttttaaaatgggattttaaaggaacgtccaattggtattaaaaattgtgatttacccgggcgataaatattttttaacccattttggggggcacttgggctg

SEQ ID NO: 345356 - DNA, 547 bp, Homo sapiens
gtctttttttgcccagtttggcccctcataatgctcctacaaataataccgtcacaacaggtcttattgatggggctgtggtcagtggcattggttctggtgaaagattcttccctcctccctccggcttaagttactctagctggttttgtattgaacattttagttctcctccaaataaccaccctgtcagacttcttactgttgtgcgccgagcaaattcttctgagcaacattacgtgtgccttgcaatagttctatcagcaaaagaccgatctctgattgtttccaccaaagaggaactcctccaaaattatgttgatgattttagtgaagagtcctcattttatgaaattctcccatgctgtgctcgctttcgatgtggagagcttatcattgagggacagtggcatcatttggtcctggtaatgagcaaaggcatgttgaaaaacagtactgcagccctttatattgatggacagcttgttaacactgtaaagcttcattatgtccacagtactccagggggttcaggttcggcaaatcc

SEQ ID NO: 345357 - DNA, 214 bp, Homo sapiens
gagagcaacttgaatcagaagctactagaagaacctgcagagttctgaagcagtttatattcttcttacattttgccttctcctagctggaaagcagagggactggaatttttgaaacgggcttttcccataatggcattcttgatttgtgtggccagagcttgcacaggaggaaagcaggctgctgaatttagtcactgatctctattagcgg

SEQ ID NO: 345358 - DNA, 797 bp, Homo sapiens
  misc_feature (715)..(715): n is a, c, g, or t
gatgatctcatcttgaggtcctcaattacatcaagatccttattccaaataatgtcacattctgagattttaggcaaacatatctttggggggccaaaattcaatcccctaatccatgttagtaaccatgcagtgttccttcttatttctatgttgaccttttcagctctttctatttattgttattatttttgagatagagtttcaatcttgttgcccaggctggagtgcaatggtgcaatcttggctcacggcaacctccgcctcccaggttcaagcaattctcctgcctcagcctcctgagtagctggtatgacaggcatgcaccaccatgcccagctaattttatatttttagtagaggcagggtttcgctgtgttggccagactggtctcaaactcctgatcttgggtgatctgccctcctcagcctcccaaagtgctgggattagaggcgtgagccaccatgcctggccagctctttctaactaaaaaataataataataataataaaaaataaaagatgatacttgcaaaaaaaaaaaaaaagaaaaaaaaaaaactggtggggcggcccgggaccgtgaaaaggtttccaagaccactccggtggggcgcgggcgcccagaggatagggacccgtgccccaggcggctccccagagagaacgggccagaacagtggctggggtccccaccataaaaaaaggccgcgnaacggcgtcgaacaatccgatggggtccgaggcacgcgctccacaacgggtccagggacggaataccgcgcgcggggggaat

SEQ ID NO: 345359 - DNA, 2925 bp, Homo sapiens
ggagcccatgatttcctggaagagccctagagctttgctttttctctcctgcagcacttaaccgaaaccagttttgcaatcaattcctgttcaaaggccaccctactcttcctatccgtctttctccagcccagacactcacagccccctgccagaccaggggacctcggagaggcaaggacagaggttcaggatcttcctctccctcgggacccaaggccacaaaggagagctccgtggagagaagaaaatcatttgactcctggggacacagatttgctgccacagaggctgatggacaaccaggcggagagagaaagtgaggctggtgttggtttgcaaagggatgaggatgacgctcctctgtgtgaagacgtggagctacaagacggagatctgtcccccgaagaaaaaatatttttgagagaatttcccagattgaaagaagatctgaaagggaacattgacaagctccgtgccctcgcagacgatattgacaaaacccacaagaaattcaccaaggctaacatggtggccacctctactgctgtcatctctggagtgatgagcctcctgggtttagcccttgccccagcaacaggaggaggaagcctgctgctctccaccgctggtcaaggtttggcaacagcagctggggtcaccagcatcgtgagtggtacgttggaacgctccaaaaataaagaagcccaagcacgggcggaagacatactgcccacctacgaccaagaggacagggaggatgaggaagagaaggcagactatgtcacagctgctggaaagattatctataatcttagaaacaccttgaagtatgccaagaaaaacgtccgtgcattttggaaactcagagccaacccacgcttggccaatgctaccaagcgtcttctgaccactggccaagtctcctcccggagccgcgtgcaggtgcaaaaggcctttgcgggaacaacactggcgatgaccaaaaatgctcgcgtgctgggaggtgtgatgtccgccttctcccttggctatgacttggccactctctcaaaggaatggaagcacctgaaggaaggagcaaggacaaagtttgcggaagagttgagagccaaggccttggagctggagaggaaactcacagaactcacccagctctacaagagcttgcagcagaaagtgaggtcaagggccagaggggtggggaaggatttaactgggacctgcgaaaccgaggcttactggaaggagttaagggagcatgtgtggatgtggctgtggctgtgtgtgtgtctgtgtgtctgtgtgtatgtacagtttacatgaatgttcctcaggacatggcatacaatggccttggaggtccaaataatatcaagtacatcttggagatgagggtgcctgtcctggacagacctcggcatgccttctgtttctccttcaatgctccttaaggcctatgtgctgggaaaagggtcttccctgtttgtttgtttgtttgtttgtttgtttgttttgagagggtcttgcactccagtctgggtgtcagaatgagaccccatctcaaaaaaaaaaaaaaaaaaaaaaaagaagaagaatacagtcatgtatctcttggtgacagggacgcattctgataaatgtgtcattaggcaattgcattgtagtgtgattatcacagattgtacttatacaaaacttagatggcatagcctactgcatacctaggctatatgggagagcctattgctcccaggctacgcacctgtacagcatgtgactactgaatactataggcaattgcagcacaatgggaaatatttgtgtatctaaacatatgtaaacagagaaaaaggaaagtaaaaatatggcataaaagataagaattggctctcctgtacagggcacttactacgaatggagcttgcagggctgagagttgctccagatgagtcagtgagtggtgaatgaatgtgaaggcctagggcattactgtatactactgtaggctttataaacacagcacacttagggtacacaaaatgcatattaaaacattttcttccttcagtatattaggcaataggaatttttcaagtccactataaatcttatcaaaccatggttgtatatgcagttgaccgaaacattgttattggacacataactatagttgaaagaataagcaaaaagtctatctaggtgtgctgtcttgagcaacttttaattattctcccgtcctgcaatatgagttaatcttctctgatcgatgtagattccaggaaggggtgtccaggacaattaccttccttctggagaaacttcccttaatcaaataagagaacttcaaagaaaatccctccctgtgctttggaagggaagggaggtgggcagcagtgggtcagagatagacctttgttctcttatttctgaggcccttcagtctcctttattcaaagcactcagcatgccaaagcaccctattttagggtatctttttctgagccctaaacactgtgttggggatgtcaactgtgacaggaaaatatcttggggccccagaatcactaaggaaaactcaagcttagggaaacttcttagggcaaacccacctcccactctattcaaagttatctctctgctcactgagatagatacatatctgattgcctcctttggaaaggctaatcagaaactcaaaagaatgcaactgtttgtgtctcacctatctgtgacctggaagctccctccccactgaaccaatgttcttcttacatatattgattaatgtcttatgtctccctaaaatgtataaaaccaaggtatgccccaaccatcttggccacatgtcatcaggacttcctgagtctgtgtcacagtgtgtcctcaaccttggcaaaataaactttctaaattaactgagac

SEQ ID NO: 345360 - DNA, 2621 bp, Homo sapiens
agagccacaggcggagttaggaactaaattgtctcctcctcccaattcatatgttgaagtcctaaaccaaaatgtggctgtatttagagatggaccctttgggaggtaattagggttgactgaggccatagggtgaggtcctaacccgatggaattgacttctttataagaggaggaggaaatacaagagggcctccccacccctgctgcacacctacactgaaggaaggctatttgcagatgcagcaagaaggcagccatctgcaaggcagaagaagagagccctcaccaggaactgaataagtcagtcagtctgggacttccagcctctagaactgtgaaacaataaatttctgtggtgtaagcaactcaatctatagtagtttgttactattttgttatagcaaccaaagatgactaagccagacaggttatgtcactcgccaagtgtcttagtctgtttgtgctgctataacaaaataccttagactgggtaatttacaaacaacagagatgtatccagagatccacagttctggaggctgagaagtctaaaatcaaggcaccagcagattccacatctcgtgaaggctcactctctgcttcacagatggcactgtcttgctgtgttctcacatggcagaaggggcaaacaagcccccctgggcctcttttataaaggcactaactctatgcctaaaggcagggccctcatgactctatcacctaccaaaaggctccacttctttatactattggaggggtagaaggaacttcctttctagaccttgaaggtttaagaatttgaatctataaaacaagctgacaatagacagattaacaggagaaaaagcatatacattttttaatgtgggccagatggcagaagcttaaataacaccccaagctacaggaagtgaggcctctgatggggaggtagtgacacaggctgtgggagggggtagggggaggaagtctgtggtgagcaaagtttgccttattacactgataaagtgtaattacactaataaagctggatcacctgaggttaggagtttgagaacagcctggccaacatggcaaaaccctgtctctactataaatacaaaaattagccaggtgtagtggcagggcacttgtaatcctatctactcgggaggctgaggcaggagaatcgcttggacccaggctgtagaggttgcagtgagccaagatcatgccactgcactccagtctgggtgtcagaatgagaccccatctcaaaaaaaaaaaaaaaaaaaaaaaagaagaagaatacagtcatgtatctcttggtgacagggacgcattctgataaatgtgtcattaggcaattgcattgtagtgtgattatcacagattgtacttatacaaaacttagatggcatagcctactgcatacctaggctatatgggagagcctattgctcccaggctacgcacctgtacagcatgtgactactgaatactataggcaattgcagcacaatgggaaatatttgtgtatctaaacatatgtaaacagagaaaaaggaaagtaaaaatatggcataaaagataagaattggctctcctgtacagggcacttactacgaatggagcttgcagggctgagagttgctccagatgagtcagtgagtggtgaatgaatgtgaaggcctagggcattactgtatactactgtaggctttataaacacagcacacttagggtacacaaaatgcatattaaaacattttcttccttcagtatattaggcaataggaatttttcaagtccactataaatcttatcaaaccatggttgtatatgcagttgaccgaaacattgttattggacacataactatagttgaaagaataagcaaaaagtctatctaggtgtgctgtcttgagcaacttttaattattctcccgtcctgcaatatgagttaatcttctctgatcgatgtagattccaggaaggggtgtccaggacaattaccttccttctggagaaacttcccttaatcaaataagagaacttcaaagaaaatccctccctgtgctttggaagggaagggaggtgggcagcagtgggtcagagatagacctttgttctcttatttctgaggcccttcagtctcctttattcaaagcactcagcatgccaaagcaccctattttagggtatctttttctgagccctaaacactgtgttggggatgtcaactgtgacaggaaaatatcttggggccccagaatcactaaggaaaactcaagcttagggaaacttcttagggcaaacccacctcccactctattcaaagttatctctctgctcactgagatagatacatatctgattgcctcctttggaaaggctaatcagaaactcaaaagaatgcaactgtttgtgtctcacctatctgtgacctggaagctccctccccactgaaccaatgttcttcttacatatattgattaatgtcttatgtctccctaaaatgtataaaaccaaggtatgccccaaccatcttggccacatgtcatcaggacttcctgagtctgtgtcacagtgtgtcctcaaccttggcaaaataaactttctaaattaactgagac

SEQ ID NO: 345361 - DNA, 3911 bp, Homo sapiens
agagccacaggcggagttaggaactaaattgtctcctcctcccaattcatatgttgaagtcctaaaccaaaatgtggctgtatttagagatggaccctttgggaggtaattagggttgactgaggccatagggtgaggtcctaacccgatggaattgacttctttataagaggaggaggaaatacaagagggcctccccacccctgctgcacacctacactgaaggaaggctatttgcagatgcagcaagaaggcagccatctgcaaggcagaagaagagagccctcaccaggaactgaataagtcagtcagtctgggacttccagcctctagaactgtgaaacaataaatttctgtggtgtaagcaactcaatctatagtagtttgttactattttgttatagcaaccaaagatgactaagccagacaggttatgtcactcgccaagtgtcttagtctgtttgtgctgctataacaaaataccttagactgggtaatttacaaacaacagagatgtatccagagatccacagttctggaggctgagaagtctaaaatcaaggcaccagcagattccacatctcgtgaaggctcactctctgcttcacagatggcactgtcttgctgtgttctcacatggcagaaggggcaaacaagcccccctgggcctcttttataaaggcactaactctatgcctaaaggcagggccctcatgactctatcacctaccaaaaggctccacttctttatactattggaggggtagaaggaacttcctttctagaccttgaaggtttaagaatttgaatctataaaacaagctgacaatagacagattaacaggagaaaaagcatatacattttttaatgtgggccagatggcagaagcttaaataacaccccaagctacaggaagtgaggcctctgatggggaggtagtgacacaggctgtgggagggggtagggggaggaagtctgtggtgagcaaagtttgccttattacactgataaagtgtaattacactaataaagctggatcacctgaggttaggagtttgagaacagcctggccaacatggcaaaaccctgtctctactataaatacaaaaattagccaggtgtagtggcagggcacttgtaatcctatctactcgggaggctgaggcaggagaatcgcttggacccaggctgtagaggttgcagtgagccaagatcatgccactgcactccagtctgggtgtcagaatgagaccccatctcaaaaaaaaaaaaaaaaaaaaaaaagaagaagaatacagtcatgtatctcttggtgacagggacgcattctgataaatgtgtcattaggcaattgcattgtagtgtgattatcacagattgtacttatacaaaacttagatggcatagcctactgcatacctaggctatatgggagagcctattgctcccaggctacgcacctgtacagcatgtgactactgaatactataggcaattgcagcacaatgggaaatatttgtgtatctaaacatatgtaaacagagaaaaaggaaagtaaaaatatggcataaaagataagaattggctctcctgtacagggcacttactacgaatggagcttgcagggctgagagttgctccagatgagtcagtgagtggtgaatgaatgtgaaggcctagggcattactgtatactactgtaggctttataaacacagcacacttagggtacacaaaatgcatattaaaacattttcttccttcagtatattaggcaataggaatttttcaagtccactataaatcttatcaaaccatggttgtatatgcagttgaccgaaacattgttattggacacataactatagttgaaagaataagcaaaaagtctatctaggtgtgctgtcttgagcaacttttaattattctcccgtcctgcaatatgagttaatcttctctgatcgatgtagattccaggaaggggtgtccaggacaattaccttccttctggagaaacttcccttaatcaaataagagaacttcaaagaaaatccctccctgtgctttggaagggaagggaggtgggcagcagtgggtcagagatagacctttgttctcttatttctgaggcccttcagtctcctttattcaaagcactcagcatgccaaagcaccctattttagggtatctttttctgagccctaaacactgtgttggggatgtcaactgtgacaggaaaatatcttggggccccagaatcactaaggaaaactcaagcttagggaaacttcttagggcaaacccacctcccactctattcaaagttatctctctgctcactgagatagatacatatctgattgcctcctttggaaaggctaatcagaaactcaaaagaatgcaactgtttgtgtctcacctatctgtgacctggaagctccctccccactgaaccaatgttcttcttacatatattgattaatgtcttatgtctccctaaaatgtataaaaccaaggtatgccccaaccatcttggccacatgtcatcaggacttcctgagtctgtgtcacagtgtgtcctcaaccttggcaaaataaactttctaaattaactgagacctgtctcggattttctgggttcacattttggaaaccatgaatggattctgggtggagatgcccctgacccttgacaaatctatcggtgcttggtaccagcatgagctaactttatggctcaaaccaataggacaatttgctgaggtctgagaggactccctccagaaaatccctgatctcttaaaatttggtagagatcggaagtttattttgctgtacaacacctctttttttggagttttacttgctcccaacaaggaaggcaagttttcctgctttcatgatgatggaaggcaggtgatgtttttatggagtttcagctttcttccaatgcacttagagcactcagaaattgtataatttgtgtgaccattgttagttttgcttaactgttttgttgtttgtttctgtcttagtcaaatctgaaggggaaccctaaattacggggtcaaggactctgaagtggtaggaaaacagccagcttaaaaaactttttttaaattttaattactataggggctttatttacataacacagccagctttttgctagccagaccaaactcaaagagcaatggctgtacttctgaaatagcaacactttgtcctagctgagatttggtaataagattttttttttaagtttttaaagaagctcagtggttgaaagtctgcttaactgaaacagtaacatccatgatgtgtgttttgtgcatgtttgtatttgaaaggccttcatgtttttgtttcttgtttgtttttctctcctaagaccttgtcttttttttgtagcaaaagttttttttttttttttccttttacttctcagttgactgaattctgttttcaccggattttttgactaaaatagctattgcaacagaggctactcttgggttaaggaagaatgtagtttcgttttatgtttaatatcgctcaaagaaaaataaaagcatctccctctaacaccaccagacttttcctctctgtaccttatcatgtaaattttgctatttgattttcacctgggttgtttcctttaatgtgcaaaaatttaaggctatttagctgacaactgcctagggttgtaaaacaggttatcaagaatctgaaagtctaagataggaaaaaaaagtgggggggcattataaatctataaaatgtacttctattggcatgcctaatacgtctttatatgtatgtatgtgttgtgtacacgatgttttagtgctaaaaatatgtaaaagagctctacttggcttaaagaaaaataaaagtgcttaaatcaga

SEQ ID NO: 345362 - DNA, 1743 bp, Homo sapiens
ggagcccatgatttcctggaagagccctagagctttgctttttctctcctgcagcacttaaccgaaaccagttttgcaatcaattcctgttcaaaggccaccctactcttcctatccgtctttctccagcccagacactcacagccccctgccagaccaggggacctcggagaggcaaggacagaggttcaggatcttcctctccctcgggacccaaggccacaaaggagagctccgtggagagaagaaaatcatttgactcctggggacacagatttgctgccacagaggctgatggacaaccaggcggagagagaaagtgaggctggtgttggtttgcaaagggatgaggatgacgctcctctgtgtgaagacgtggagctacaagacggagatctgtcccccgaagaaaaaatatttttgagagaatttcccagattgaaagaagatctgaaagggaacattgacaagctccgtgccctcgcagacgatattgacaaaacccacaagaaattcaccaaggctaacatggtggccacctctactgctgtcatctctggagtgatgagcctcctgggtttagcccttgccccagcaacaggaggaggaagcctgctgctctccaccgctggtcaaggtttggcaacagcagctggggtcaccagcatcgtgagtggtacgttggaacgctccaaaaataaagaagcccaagcacgggcggaagacatactgcccacctacgaccaagaggacagggaggatgaggaagagaaggcagactatgtcacagctgctggaaagattatctataatcttagaaacaccttgaagtatgccaagaaaaacgtccgtgcattttggaaactcagagccaacccacgcttggccaatgctaccaagcgtcttctgaccactggccaagtctcctcccggagccgcgtgcaggtgcaaaaggcctttgcgggaacaacactggcgatgaccaaaaatgctcgcgtgctgggaggtgtgatgtccgccttctcccttggctatgacttggccactctctcaaaggaatggaagcacctgaaggaaggagcaaggacaaagtttgcggaagagttgagagccaaggccttggagctggagaggaaactcacagaactcacccagctctacaagagcttgcagcagaaagtgaggtcaagggccagaggggtggggaaggatttaactgggacctgcgaaaccgaggcttactggaaggagttaagggagcatgtgtggatgtggctgtggctgtgtgtgtgtctgtgtgtctgtgtgtatgtacagtttacatgaatgttcctcaggacatggcatacaatggccttggaggtccaaataatatcaagtacatcttggagatgagggtgcctgtcctggacagacctcggcatgccttctgtttctccttcaatgctccttaaggcctatgtgctgggaaaagggtcttccctgtttgtttgtttgtttgtttgtttgtttgttttgagagggtctctgttgcccaggctggagtgcagtggcgtaatctcggctcactgcaacctctgcctcctgagtgcaagcaagtctcctgcctcagcctcccaagtagctgggattacaggcacgcaccaccacgcccagctaattttggtatttttttgtagagacagggtttcaccattttggccaggctggtctcgaattcctgacctcaagtgatccacccac

SEQ ID NO: 345363 - DNA, 2868 bp, Homo sapiens
ctagaattcagcggccgctttttttctagaattcagcgccgctgaattccacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttgtatttgctatttttcccctatgagaagatattttgatctccccaatacattgattttggtataataaatgtgaggctgttttgcaaacttaacttgcaggaatggtatcgactcgtgtttcctactgctttattctgtaaacaagaattgtagcaccatgaaacagacctctgggtcccagtgggcattttttcccctttcaggatgtaggaggacatgtatagtatgtcaaaaactgcaagcttttcccaactttaaccttaccagcatgttaatatccagtttttttatagtttaaaagttaaagtgcctcatattttgaaaatatccattaaggacccaggaattagcatttcacttgtttatacatttttataacattatgaagacgatataaaaatcctagaactgaagagtcttcctttggtatatgtgcaggaagatagttgtatatctctgttccacaaagaacgcaacacagtctctaaactttttggtgtaagcttctagccttgggtattttccagtggggaatgtttaaaaatatttgaccaaaccaaagactttttgcctcttatagcaagcataaagactgtactgcctggcttttgtattccttcagacattattgtaaatgtgcaactcctcttccctcttgtaaacctttataagatgtctgccaccccaagcttttgtcttgatagttttaaattgatgccatgaaatttcttagttttcgttccctttctctagttatctctttccttatgtcacctcatttcccatcattcttgtcactaatgatgaatgatcattacaaattggtatgctgtcaaattttgataaatgtgccaaacaaaggaggatatacagtgccatggcaattttgtgtcatggtcaagttatgatatcatatgacttgagaatagtatgtaagagatgctgtagaagatcacgttggtaccaaagaaagggcacatgtctatcggaacatagattttgcatactgcatggtatggtcaggctttgtgtccacacccaaatctcatcttgaaattataatccccataatttccataatccccacatgtcaatggagagaccaggtggaggtaactgaatcatgggggtggttttccccgtgctgttctcatgcaatctgatggttttataagtgtttggtagttcctcttgcattcattctcccacccgccaccttgtgaagaaagtccttgcttccccgccttccaccatgattgtaagcttcctgaggcctccccagccatggggaaccatgagtcaatttaacctctttcctttacaaattacccagtctggggcagttctttatagcagtgtgaaaatggactactacactgcatatataggaaagtatggtcagacagtaaatagctctgttcaaaataattgagttccaaacaagtaaagttttttctaccttctgaaacttgctctttccaaaccattgttcatcctttaacttctttacactatcaaaaattctatttaaaaatagagggctttcagatgagtacatacaaaaacaaacaaaagtatacataggggtaacacaaccatgagattagtaaataatacatatggctagcacataatttgacaccttataaaacaagaatctgtactatcttttccttcctcccaatatttcttcatttctatgctcaattttctaatactttttcacatgcttaatcatttactctttcatcgccttccctcaaaaaaacctgctccgttgaagtaaactaagtaactcaatattctttattttggtttggaacctgtctcaattttttgtatccatattaagaagtcaccctataatctaaactttgtaattctaatttttttgtcccattatcatacaaagtgcttttaaacttgtttttaaaaaatgacagataatgccacatgaataggaagatgattcattctaaaacttgtatttacataattaaaaataaatttataatcattctacatacaaaaaaatg

SEQ ID NO: 345364 - DNA, 1048 bp, Homo sapiens
gcaggacaacgcctgccacgcgtcggaactcggccgcgggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatggtagtacttgaagaagtctttcttctgcaaaatatccttgtctcatgtcacagaacaaccctgcatgtcttgaaatgcatgtgacttgttagtgcttaaataacaatacatgcgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttgtatttgctatttttcccctatgagaagatattttgatctccccaatacattgattttggtataataaatgtgaggctgttttgcaaactt

SEQ ID NO: 345365 - DNA, 2880 bp, Homo sapiens
gcaggacaacgcctgccacgcgtcggaactcggccgcgggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttgtatttgctatttttcccctatgagaagatattttgatctccccaatacattgattttggtataataaatgtgaggctgttttgcaaacttaacttgcaggaatggtatcgactcgtgtttcctactgctttattctgtaaacaagaattgtagcaccatgaaacagacctctgggtcccagtgggcattttttcccctttcaggatgtaggaggacatgtatagtatgtcaaaaactgcaagcttttcccaactttaaccttaccagcatgttaatatccagtttttttatagtttaaaagttaaagtgcctcatattttgaaaatatccattaaggacccaggaattagcatttcacttgtttatacatttttataacattatgaagacgatataaaaatcctagaactgaagagtcttcctttggtatatgtgcaggaagatagttgtatatctctgttccacaaagaacgcaacacagtctctaaactttttggtgtaagcttctagccttgggtattttccagtggggaatgtttaaaaatatttgaccaaaccaaagactttttgcctcttatagcaagcataaagactgtactgcctggcttttgtattccttcagacattattgtaaatgtgcaactcctcttccctcttgtaaacctttataagatgtctgccaccccaagcttttgtcttgatagttttaaattgatgccatgaaatttcttagttttcgttccctttctctagttatctctttccttatgtcacctcatttcccatcattcttgtcactaatgatgaatgatcattacaaattggtatgctgtcaaattttgataaatgtgccaaacaaaggaggatatacagtgccatggcaattttgtgtcatggtcaagttatgatatcatatgacttgagaatagtatgtaagagatgctgtagaagatcacgttggtaccaaagaaagggcacatgtctatcggaacatagattttgcatactgcatggtatggtcaggctttgtgtccacacccaaatctcatcttgaaattataatccccataatttccataatccccacatgtcaatggagagaccaggtggaggtaactgaatcatgggggtggttttccccgtgctgttctcatgcaatctgatggttttataagtgtttggtagttcctcttgcattcattctcccacccgccaccttgtgaagaaagtccttgcttccccgccttccaccatgattgtaagcttcctgaggcctccccagccatggggaaccatgagtcaatttaacctctttcctttacaaattacccagtctggggcagttctttatagcagtgtgaaaatggactactacactgcatatataggaaagtatggtcagacagtaaatagctctgttcaaaataattgagttccaaacaagtaaagttttttctaccttctgaaacttgctctttccaaaccattgttcatcctttaacttctttacactatcaaaaattctatttaaaaatagagggctttcagatgagtacatacaaaaacaaacaaaagtatacataggggtaacacaaccatgagattagtaaataatacatatggctagcacataatttgacaccttataaaacaagaatctgtactatcttttccttcctcccaatatttcttcatttctatgctcaattttctaatactttttcacatgcttaatcatttactctttcatcgccttccctcaaaaaaacctgctccgttgaagtaaactaagtaactcaatattctttattttggtttggaacctgtctcaattttttgtatccatattaagaagtcaccctataatctaaactttgtaattctaatttttttgtcccattatcatacaaagtgcttttaaacttgtttttaaaaaatgacagataatgccacatgaataggaagatgattcattctaaaacttgtatttacataattaaaaataaatttataatcattctacatacaaaaaaatg

SEQ ID NO: 345366 - DNA, 3263 bp, Homo sapiens
caccgtttattttcactattcaattgaaagtattttgtatgggccggccgcattcagctttatttttaatgctttttgccaataatttgatcccatcagaacagctcccatggtaccataattcatatatcctgtttttatttgtataggaacctaggagaaagagaaggaaaattgaaaataaattaagtcaaatgcaatacttgtgctaaaaatgttgtcaaaagttgaggccacttctatctgcctagagcacacacatctgtcatcatcaggtgctcatccagggttcaccgccatcaggcaaaggaccacttagcttatctttttcataaactaatttatgcttagatatgaatgactacccaggctgcctaagctcttaataaatcagaaacttgctgcagagatatagaagtttgatgtgaaacaagttcatattcaattggaggtatctctaacaaacattaaagtgattaatctcactagtaataccaccagcaccctcattttacagagtaagaaactgaggcccaaaaaaagtgttaattggaccatagttaatactgaccttgcctgcgttacattaggcattgtaatccaataccttggattacattattttaaaagttgcagtgtagaccttaagtaactgtttaacaaacaacctcttgattaaataagcatttaaaagtaagttgttattaagacctaacattagctataactttattttaggtagtacttgaagaagtctttcttctgcaaaatatccttgtctcatgtcacagaacaaccctgcatgtcttgaaatgcatgtgacttgttagtgcttaaataacaatacatgcgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttgtatttgctatttttcccctatgagaagatattttgatctccccaatacattgattttggtataataaatgtgaggctgttttgcaaacttaacttgcaggaatggtatcgactcgtgtttcctactgctttattctgtaaacaagaattgtagcaccatgaaacagacctctgggtcccagtgggcattttttcccctttcaggatgtaggaggacatgtatagtatgtcaaaaactgcaagcttttcccaactttaaccttaccagcatgttaatatccagtttttttatagtttaaaagttaaagtgcctcatattttgaaaatatccattaaggacccaggaattagcatttcacttgtttatacatttttataacattatgaagacgatataaaaatcctagaactgaagagtcttcctttggtatatgtgcaggaagatagttgtatatctctgttccacaaagaacgcaacacagtctctaaactttttggtgtaagcttctagccttgggtattttccagtggggaatgtttaaaaatatttgaccaaaccaaagactttttgcctcttatagcaagcataaagactgtactgcctggcttttgtattccttcagacattattgtaaatgtgcaactcctcttccctcttgtaaacctttataagatgtctgccaccccaagcttttgtcttgatagttttaaattgatgccatgaaatttcttagttttcgttccctttctctagttatctctttccttatgtcacctcatttcccatcattcttgtcactaatgatgaatgatcattacaaattggtatgctgtcaaattttgataaatgtgccaaacaaaggaggatatacagtgccatggcaattttgtgtcatggtcaagttatgatatcatatgacttgagaatagtatgtaagagatgctgtagaagatcacgttggtaccaaagaaagggcacatgtctatcggaacatagattttgcatactgcatggtatggtcaggctttgtgtccacacccaaatctcatcttgaaattataatccccataatttccataatccccacatgtcaatggagagaccaggtggaggtaactgaatcatgggggtggttttccccgtgctgttctcatgcaatctgatggttttataagtgtttggtagttcctcttgcattcattctcccacccgccaccttgtgaagaaagtccttgcttccccgccttccaccatgattgtaagcttcctgaggcctccccagccatggggaaccatgagtcaatttaacctctttcctttacaaattacccagtctggggcagttctttatagcagtgtgaaaatggactactacactgcatatataggaaagtatggtcagacagtaaatagctctgttcaaaataattgagttccaaacaagtaaagttttttctaccttctgaaacttgctctttccaaaccattgttcatcctttaacttctttacactatcaaaaattctatttaaaaatagagggctttcagatgagtacatacaaaaacaaacaaaagtatacataggggtaacacaaccatgagattagtaaataatacatatggctagcacataatttgacaccttataaaacaagaatctgtactatcttttccttcctcccaatatttcttcatttctatgctcaattttctaatactttttcacatgcttaatcatttactctttcatcgccttccctcaaaaaaacctgctccgttgaagtaaactaagtaactcaatattctttattttggtttggaacctgtctcaattttttgtatccatattaagaagtcaccctataatctaaactttgtaattctaatttttttgtcccattatcatacaaagtgcttttaaacttgtttttaaaaaatgacagataatgccacatgaataggaagatgattcattctaaaacttgtatttacataattaaaaataaatttataatcattctacatacaaaaaaatg

SEQ ID NO: 345367 - DNA, 2728 bp, Homo sapiens
gcaggacaacgcctgccacgcgtcggaactcggccgcgggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttgtatttgctatttttcccctatgagaagatattttgatctccccaatacattgattttggtataataaatgtgaggctgttttgcaaacttaacttgcaggaatggtatcgactcgtgtttcctactgctttattctgtaaacaagaattgtagcaccatgaaacagacctctgggtcccagtgggcattttttcccctttcaggatgtaggaggacatgtatagtatgtcaaaaactgcaagcttttcccaactttaaccttaccagcatgttaatatccagtttttttatagtttaaaagttaaagtgcctcatattttgaaaatatccattaaggacccaggaattagcatttcacttgtttatacatttttataacattatgaagacgatataaaaatcctagaactgaagagtcttcctttggtatatgtgcaggaagatagttgtatatctctgttccacaaagaacgcaacacagtctctaaactttttggtgtaagcttctagccttgggtattttccagtggggaatgtttaaaaatatttgaccaaaccaaagactttttgcctcttatagcaagcataaagactgtactgcctggcttttgtattccttcagacattattgtaaatgtgcaactcctcttccctcttgtaaacctttataagatgtctgccaccccaagcttttgtcttgatagttttaaattgatgccatgaaatttcttagttttcgttccctttctctagttatctctttccttatgtcacctcatttcccatcattcttgtcactaatgatgaatgatcattacaaattggtatgctgtcaaattttgataaatgtgccaaacaaaggaggatatacagtgccatggcaattttgtgtcatggtcaagttatgatatcatatgacttgagaatagtatgtaagagatgctgtagaagatcacgttggtaccaaagaaagggcacatgtctatcggaacatagattttgcatactgcatggtatggtcaggctttgtgtccacacccaaatctcatcttgaaattataatccccataatttccataatccccacatgtcaatggagagaccaggtggaggtaactgaatcatgggggtggttttccccgtgctgttctcatgcaatctgatggttttataagtgtttggtagttcctcttgcattcattctcccacccgccaccttgtgaagaaagtccttgcttccccgccttccaccatgattgtaagcttcctgaggcctccccagccatggggaaccatgagtcaatttaacctctttcctttacaaattacccagtctggggcagttctttatagcagtgtgaaaatggactactacactgcatatataggaaagtatggtcagacagtaaatagctctgttcaaaataattgagttccaaacaagtaaagttttttctaccttctgaaacttgctctttccaaaccattgttcatcctttaacttctttacactatcaaaaattctatttaaaaatagagggctttcagatgagtacatacaaaaacaaacaaaagtatacataggggtaacacaaccatgagattagtaaataatacatatggctagcacataatttgacaccttataaaacaagaatctgtactatcttttccttcctcccaatatttcttcatttctatgctcaattttctaatactttttcacatgcttaatcatttactctttcatcgccttccctcaaaaaaacctgctccgttgaagtaaactaagtaactcaatattctttattttggtttggaacctgtctcaattttttgtatccatattaagaagtcaccctataatctaaactttgtaattctaatttttttgtcccattatcatacaaagtgcttttaaacttgtttttaaaaaatgacagataatgccacatgaataggaagatgattcattctaaaacttgtatttacataattaaaaataaatttataatcattctacatacaaaaaaatg

SEQ ID NO: 345368 - DNA, 938 bp, Homo sapiens
caccgtttattttcactattcaattgaaagtattttgtatgggccggccgcattcagctttatttttaatgctttttgccaataatttgatcccatcagaacagctcccatggtaccataattcatatatcctgtttttatttgtataggaacctaggagaaagagaaggaaaattgaaaataaattaagtcaaatgcaatacttgtgctaaaaatgttgtcaaaagttgaggccacttctatctgcctagagcacacacatctgtcatcatcaggtgctcatccagggttcaccgccatcaggcaaaggaccacttagcttatctttttcataaactaatttatgcttagatatgaatgactacccaggctgcctaagctcttaataaatcagaaacttgctgcagagatatagaagtttgatgtgaaacaagttcatattcaattggaggtatctctaacaaacattaaagtgattaatctcactagtaataccaccagcaccctcattttacagagtaagaaactgaggcccaaaaaaagtgttaattggaccatagttaatactgaccttgcctgcgttacattaggcattgtaatccaataccttggattacattattttaaaagttgcagtgtagaccttaagtaactgtttaacaaacaacctcttgattaaataagcatttaaaagtaagttgttattaagacctaacattagctataactttattttaggtagtacttgaagaagtctttcttctgcaaaatatccttgtctcatgtcacagaacaaccctgcatgtcttgaaatgcatgtgacttgttagtgcttaaataacaatacatgcggtatgtatatattctttaccttaattcctacttctttgatctgcttctctaaatataagtatcttacggatacttatataaataag

SEQ ID NO: 345369 - DNA, 669 bp, Homo sapiens
gcaggacaacgcctgccacgcgtcggaactcggccgcgggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatggtagtacttgaagaagtctttcttctgcaaaatatccttgtctcatgtcacagaacaaccctgcatgtcttgaaatgcatgtgacttgttagtgcttaaataacaatacatgcggtatgtatatattctttaccttaattcctacttctttgatctgcttctctaaatataagtatcttacggatacttatataaataag

SEQ ID NO: 345370 - DNA, 509 bp, Homo sapiens
gcaggacaacgcctgccacgcgtcggaactcggccgcgggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcaggtaggaaatgctgcgagctgcccgtgcgtccagttgcacaaaatcttgcctgcctccaccaagcggaagcctcattggttggttggttggggttttattttttaacggtaaaagttgagccctttattcattaaaaaaatcacattatatggcagtgtttctctaataaactgaatatttttatttaaagtg

SEQ ID NO: 345371 - DNA, 300 bp, Homo sapiens
ctttatttttaatgctttttgccaataatttgatcccatcagaacagctcccatggtaccataattcatatatcctgtttttatttgtataggaacctaggagaaagagaaggaaaattgaaaataaattaagtcaaatgcaatacttgtgctaaaaatgttgtcaaaagttgaggccacttctaggcaaaatgttggaggcagagtttgcctttcagtctctttctcattttcaaagttttcctttctgtcttgcgttgtgtcttcagatgcctccacattctgcctaccactagagca

SEQ ID NO: 345372 - DNA, 451 bp, Homo sapiens
tactgttgtatcatttactgtaagtaatcttgcacatgagtttcattattataactattccttaaagttactggaaattcactgtgataccttttaattaaaggaatgttattttggccttccagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttgtatttgctatttttcccctatgagaagatattttgatctccccaatacattgattttggtataataaatgtgaggctgttttgca

SEQ ID NO: 345373 - DNA, 695 bp, Homo sapiens
  misc_feature (25)..(25): n is a, c, g, or t
  misc_feature (103)..(103): n is a, c, g, or t
  misc_feature (139)..(139): n is a, c, g, or t
aagagaatgcttaaaccaggagcgngaagttgcagtgagccgagatcgcaccactgtactcaggctgggcgacagaacaagactccgtctcaaaaaaaaaaanaaaaaactcgagactagttctctctctctcgtgcgnaattcggcacgagctatgacagatatgtgccctggagaaaagcgaaaagtagttatacccccttcatttgcatacggaaaggaaggctatgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttgtatttgctatttttcccctatgagaagatattttgatctccccaatacattgattttggtataataaatgtgaggctgttttgcaaactt

SEQ ID NO: 345374 - DNA, 2994 bp, Homo sapiens
gcaggacaacgcctgccacgcgtcggaactcggccgcgggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatggtagtacttgaagaagtctttcttctgcaaaatatccttgtctcatgtcacagaacaaccctgcatgtcttgaaatgcatgtgacttgttagtgcttaaataacaatacatgcgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttgtatttgctatttttcccctatgagaagatattttgatctccccaatacattgattttggtataataaatgtgaggctgttttgcaaacttaacttgcaggaatggtatcgactcgtgtttcctactgctttattctgtaaacaagaattgtagcaccatgaaacagacctctgggtcccagtgggcattttttcccctttcaggatgtaggaggacatgtatagtatgtcaaaaactgcaagcttttcccaactttaaccttaccagcatgttaatatccagtttttttatagtttaaaagttaaagtgcctcatattttgaaaatatccattaaggacccaggaattagcatttcacttgtttatacatttttataacattatgaagacgatataaaaatcctagaactgaagagtcttcctttggtatatgtgcaggaagatagttgtatatctctgttccacaaagaacgcaacacagtctctaaactttttggtgtaagcttctagccttgggtattttccagtggggaatgtttaaaaatatttgaccaaaccaaagactttttgcctcttatagcaagcataaagactgtactgcctggcttttgtattccttcagacattattgtaaatgtgcaactcctcttccctcttgtaaacctttataagatgtctgccaccccaagcttttgtcttgatagttttaaattgatgccatgaaatttcttagttttcgttccctttctctagttatctctttccttatgtcacctcatttcccatcattcttgtcactaatgatgaatgatcattacaaattggtatgctgtcaaattttgataaatgtgccaaacaaaggaggatatacagtgccatggcaattttgtgtcatggtcaagttatgatatcatatgacttgagaatagtatgtaagagatgctgtagaagatcacgttggtaccaaagaaagggcacatgtctatcggaacatagattttgcatactgcatggtatggtcaggctttgtgtccacacccaaatctcatcttgaaattataatccccataatttccataatccccacatgtcaatggagagaccaggtggaggtaactgaatcatgggggtggttttccccgtgctgttctcatgcaatctgatggttttataagtgtttggtagttcctcttgcattcattctcccacccgccaccttgtgaagaaagtccttgcttccccgccttccaccatgattgtaagcttcctgaggcctccccagccatggggaaccatgagtcaatttaacctctttcctttacaaattacccagtctggggcagttctttatagcagtgtgaaaatggactactacactgcatatataggaaagtatggtcagacagtaaatagctctgttcaaaataattgagttccaaacaagtaaagttttttctaccttctgaaacttgctctttccaaaccattgttcatcctttaacttctttacactatcaaaaattctatttaaaaatagagggctttcagatgagtacatacaaaaacaaacaaaagtatacataggggtaacacaaccatgagattagtaaataatacatatggctagcacataatttgacaccttataaaacaagaatctgtactatcttttccttcctcccaatatttcttcatttctatgctcaattttctaatactttttcacatgcttaatcatttactctttcatcgccttccctcaaaaaaacctgctccgttgaagtaaactaagtaactcaatattctttattttggtttggaacctgtctcaattttttgtatccatattaagaagtcaccctataatctaaactttgtaattctaatttttttgtcccattatcatacaaagtgcttttaaacttgtttttaaaaaatgacagataatgccacatgaataggaagatgattcattctaaaacttgtatttacataattaaaaataaatttataatcattctacatacaaaaaaatg

SEQ ID NO: 345375 - DNA, 934 bp, Homo sapiens
gcaggacaacgcctgccacgcgtcggaactcggccgcgggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttgtatttgctatttttcccctatgagaagatattttgatctccccaatacattgattttggtataataaatgtgaggctgttttgcaaactt

SEQ ID NO: 345376 - DNA, 1626 bp, Homo sapiens
gtggcagcctcgggagtcagggctccctggtccttgacccagctccatccggcggggcccttgtggctgagatcctactgcaggcttagcctatttcggtctctggcttcctctagacacaggcaggagagctggcccaagcacattgataagagcctagtgcccagggattaggagagaaggcatcagctccatcaggtcatctcaggaggggccagaaaagtccagagctgcagtgcccaaagctaccctggtgggaagggttaggggcagtagctcccccagggcttctccagggcagcacagggaccccggatgaagactctgtcccccctcaggcattcagctgcccacaagtttcctgcaccctggaaaagccccccacccttcctctgggaaactgacagctgtcttccacagcctctgatgtggacctggtactgaggagcaagactgtccagttctcctccacatctcccatcccagaatcaggatctgggactggcagggtcccctcctgtgtctcatctcttgcagcagcagctgctgaactccagccatcaacacggtgggaggcagcgggggcttcagccatgtcctagctccccgccctaaaaggaggcagtgaggaccaggcactatttcctccgaggttacttctacccagatgacacctgcctgttcacgccccaaggcagctactgcccctaacccttcccaccagggtagctttgggcactgcagctctggacttttctggcccctcctgagatgacctgatggagctgatgctttctctcctaatccctgggcactaggctcttatcagtgtgcttgggccagctctcctgcctgtgtctagaggaagccagagacagaaataggctaagcctgcagtaggatctcagccacaagggccccgcaggatggagctgggtcaaggaccagggagccctgactcccagaggctgccaccggggagaagcagcggtcctccatccagaacctaagggctgaagcaaaggctgccaggacccttgaagatgcttttggctcacctcatttcaccccacgctctgctggctggcagaggagaaggcagtcgtttcctctctgaagagtatttttttcgattgccctctggttagggtgcacatataaatcagagttaatatatgaacgcgtgtgcatgcacaagtgtgtgtgtgcctgcgtgctgtgcgtggcagggtgtgtgtgtgtgtgtctggctgtgcgttccggagtgtgtgacgatgctgacctagctgtgtggccttgggcttgctgcttcattactcacctggatggggacgagggatgagaagggtgtgggtttggccccatgtcactggccggaaggatgtgtctcagccctgccctgtggggtgcccccgatgggaggctgtcccatctcccagtccccatctctttttccccacactgtccctggccaagccctgcccagagctgaaccctgtagctgcccccttgccctgtgtgggattcgcagtgtctcatttggtgacgtcttactggtgatcatctcctcaccccatctcccaccttgtggaataaatacatgttagcacttcccaaaaaaaaaac

SEQ ID NO: 345377 - DNA, 1015 bp, Homo sapiens
agtaccaggcagaggtggccaggggagtttcattgtgtttttttttccttttagtttctagttacattttggttgtagatgactcgcttaatcttttaagccaacacttgcctgagagcatgtttttatttcagaaatccaactttacctattttttaagctaactggaaatggaggccatgcgccccaaagcagcccgccacccacctgaatgtaagaagtgagtccggcttttgggtttcaccccaagttatctcaaaacaaaagggctggtcaggctgggcggggccttgtacgcgtacaaggccccgcaggatggagctgggtcaaggaccagggagccctgactcccagaggctgccaccggggagaagcagcggtcctccatccagaacctaagggctgaagcaaaggctgccaggacccttgaagatgcttttggctcacctcatttcaccccacgctctgctggctggcagaggagaaggcagtcgtttcctctctgaagagtatttttttcgattgccctctggttagggtgcacatataaatcagagttaatatatgaacgcgtgtgcatgcacaagtgtgtgtgtgcctgcgtgctgtgcgtggcagggtgtgtgtgtgtgtgtctggctgtgcgttccggagtgtgtgacgatgctgacctagctgtgtggccttgggcttgctgcttcattactcacctggatggggacgagggatgagaagggtgtgggtttggccccatgtcactggccggaaggatgtgtctcagccctgccctgtggggtgcccccgatgggaggctgtcccatctcccagtccccatctctttttccccacactgtccctggccaagccctgcccagagctgaaccctgtagctgcccccttgccctgtgtgggattcgcagtgtctcatttggtgacgtcttactggtgatcatctcctcaccccatctcccaccttgtggaataaatacatgttagcacttcccaaaaaaaaaac

SEQ ID NO: 345378 - DNA, 2180 bp, Homo sapiens
gtatggctctgtgggggcagcatggaggtccttccttgctcacgggtggcccacattgagcggaagaagaagccatataatagcaacattggcttctacaccaagaggaatgctcttcgcgttgctgaggtctggatggacgattacaagtctcatgtgtacatagcgtggaacctgccgctggagaatccgggaattgacatcggtgatgtctccgaaagaagagcattaaggaaaagtttaaagtgtaagaatttccagtggtacctggaccatgtttacccagaaatgagaagatacaataataccgttgcttacggggagcttcgcaacaacaaggcaaaagacgtctgcttggaccaggggccgctggagaaccacacagcaatattgtatccgtgccatggctggggaccacagcttgcccgctacaccaaggaaggcttcctgcacttgggtgccctggggaccaccacactcctccctgacacccgctgcctggtggacaactccaagagtcggctgccccagctcctggactgcgacaaggtcaagagcagcctgtacaagcgctggaacttcatccagaatggagccatcatgaacaagggcacgggacgctgcctggaggtggagaaccggggcctggctggcatcgacctcatcctccgcagctgcacaggtcagaggtggaccattaagaactccatcaagtagagggagggagctggggcactggagcctggcccccaggacatggctgctccccccaacatctggaccagctgccctggcggagagacagcaaggggccggcaggtgctcgatgggccccccagggcttctccagggcagcacagggaccccggatgaagactctgtcccccctcaggcattcagctgcccacaagtttcctgcaccctggaaaagccccccacccttcctctgggaaactgacagctgtcttccacagcctctgatgtggacctggtactgaggagcaagactgtccagttctcctccacatctcccatcccagaatcaggatctgggactggcagggtcccctcctgtgtctcatctcttgcagcagcagctgctgaactccagccatcaacacggtgggaggcagcgggggcttcagccatgtcctagctccccgccctaaaaggaggcagtgaggaccaggcactatttcctccgaggttacttctacccagatgacacctgcctgttcacgccccaaggcagctactgcccctaacccttcccaccagggtagctttgggcactgcagctctggacttttctggcccctcctgagatgacctgatggagctgatgctttctctcctaatccctgggcactaggctcttatcagtgtgcttgggccagctctcctgcctgtgtctagaggaagccagagacagaaataggctaagcctgcagtaggatctcagccacaagggccccgcaggatggagctgggtcaaggaccagggagccctgactcccagaggctgccaccggggagaagcagcggtcctccatccagaacctaagggctgaagcaaaggctgccaggacccttgaagatgcttttggctcacctcatttcaccccacgctctgctggctggcagaggagaaggcagtcgtttcctctctgaagagtatttttttcgattgccctctggttagggtgcacatataaatcagagttaatatatgaacgcgtgtgcatgcacaagtgtgtgtgtgcctgcgtgctgtgcgtggcagggtgtgtgtgtgtgtgtctggctgtgcgttccggagtgtgtgacgatgctgacctagctgtgtggccttgggcttgctgcttcattactcacctggatggggacgagggatgagaagggtgtgggtttggccccatgtcactggccggaaggatgtgtctcagccctgccctgtggggtgcccccgatgggaggctgtcccatctcccagtccccatctctttttccccacactgtccctggccaagccctgcccagagctgaaccctgtagctgcccccttgccctgtgtgggattcgcagtgtctcatttggtgacgtcttactggtgatcatctcctcaccccatctcccaccttgtggaataaatacatgttagcacttcccaaaaaaaaaac

SEQ ID NO: 345379 - DNA, 996 bp, Homo sapiens
cctccacatctgtcctcacatcatgggtgctacccgccctctccataccccatcagctttaggaatcagtcttcgtttgagaaagagtaaagcacccccaacccccatagctctccttctgcatcagagaagctgcaaggatgcctcaagagaccagccgccagcacaggcctcaaaggcaggtgcacccctgcgaggacgcatggctcgggtggctcctgggagcctctggaaggggcgtcatcagccctgtcccaccctccgcggggccttgtacgcgtacaaggccccgcaggatggagctgggtcaaggaccagggagccctgactcccagaggctgccaccggggagaagcagcggtcctccatccagaacctaagggctgaagcaaaggctgccaggacccttgaagatgcttttggctcacctcatttcaccccacgctctgctggctggcagaggagaaggcagtcgtttcctctctgaagagtatttttttcgattgccctctggttagggtgcacatataaatcagagttaatatatgaacgcgtgtgcatgcacaagtgtgtgtgtgcctgcgtgctgtgcgtggcagggtgtgtgtgtgtgtgtctggctgtgcgttccggagtgtgtgacgatgctgacctagctgtgtggccttgggcttgctgcttcattactcacctggatggggacgagggatgagaagggtgtgggtttggccccatgtcactggccggaaggatgtgtctcagccctgccctgtggggtgcccccgatgggaggctgtcccatctcccagtccccatctctttttccccacactgtccctggccaagccctgcccagagctgaaccctgtagctgcccccttgccctgtgtgggattcgcagtgtctcatttggtgacgtcttactggtgatcatctcctcaccccatctcccaccttgtggaataaatacatgttagcacttcccaaaaaaaaaac

SEQ ID NO: 345380 - DNA, 580 bp, Homo sapiens
  misc_feature (32)..(32): n is a, c, g, or t
  misc_feature (36)..(38): n is a, c, g, or t
  misc_feature (40)..(40): n is a, c, g, or t
  misc_feature (57)..(57): n is a, c, g, or t
aaaaaaaaaaaaaaaaaaaaaaaaaaaaaganaaannnanataggaaagaagcaacnctcctactgtgcatgtctgataaactgtgggaacagatagtccagtcgacctgcgacaccatcactcctgacgtgagggccctggcggaggacacaggctggagacagctgttcttcaccaacaagctccagctccagcggcagctccgcaagaggaaacaaaaatatggaaacctgagagaaaagcaaccttaggcacacattttcctaccagcagggagctcaggcatggctgtgtttctcttcagtgtccaaatctcttctgtctccttttcttaagaactaagaggttttgttgatgcgtggagccatttgaaactcgtaggggatttgcacacaaatgcagcagagtctggctccccagtgccttgctagagtcaccgtcattctgaggtcaaatcatggcccgaggacaagggctgtaagacagggagccccataggccatcatcatccttatcccacacccattataaaagaggtttctattgtatataaacaaacaataaatgattattagcagg

SEQ ID NO: 345381 - DNA, 502 bp, Homo sapiens
tggcacctgcagttaaaaccctaacaatatacattgtcattttacaaaataaaattaatagcttcacttctacttcattttaaaataagatcatctgcactctgaggcagcattcgtctgcccttgcaacgtgtaactgtcagagtggggtactacagaggactacctgcattatattccctcaaaaacggttttccactcaggaaagttattttcaattgggaaatctgttctgcccattcaaaaagtcttacagccactgatccatggccacagactgcactggaataacctcagaaataataatattagcagcttctatctattgtctactatgtgccaagaaataaacagatagtaaacaactgaattcttaacagcaatccttaaaagtaagtgatattatttctgtcatttctctcaggggtctacaaattatggcgtggacctaatctgaccagcctcctgatttataaataaagctttattggaacagtattta

SEQ ID NO: 345382 - DNA, 785 bp, Homo sapiens
tgtctgagcgacggcggtggcgtcccaagatggcgtcgtggctgccggagactctctttgaaactgtaggacaaggcccgccgcctagcaaagactattaccagttactggtcacccggtctcaggtaatctttagatggtggaagatctctctaaggagtgagtatcgatcaacaaaacctggagaagcaaaagaaacccatgaagacttcctagagaattcacatcttcaaggtcaaactgccttaatatttggtgcaagaatattagactatgtcatcaatttgtgcaaaggtaaatttgacttccttgaacggctctcagacgatttgctcctgactatcatttcttatctggatcttgaagatattgccaggctttgtcaaacatcacacagatttgcaaagacagaatcttgctgctgtcgcccaggctggagtgcaatggtacaatctcggctcactgcaatctctgcctcctgggttcaagcaattctcctgcctcagcctcccaagtagctgggaccacaggccgaacaataccactattcttaactcattttagaggaaataaataaaaataaaatgtggagaacaggggacaacaaaagagaggcgcccagaggggtggaggagtgcaaagggggcgcaagaaaccagagagaacacggggaggaaagcatcagagaccatcaggggggtaacagggacaaatcaacccagggaacaggagccccccccagaagagacgcggggaaaaacaaagggggcccacgtgaaacacag

SEQ ID NO: 345383 - DNA, 1040 bp, Homo sapiens
tgtctgagcgacggcggtggcgtcccaagatggcgtcgtggctgccggagactctctttgaaactgtaggacaaggcccgccgcctagcaaagactattaccagttactggtcacccggtctcagaaaaattgagtttgcatagccgggcgcagtggcttacgcctgtaatcccagcactttgggaggccgagccaggtggatcacgacgtctggagttggagaccagcctgacaaacatggtaatctttagatggtggaagatctctctaaggagtgagtatcgatcaacaaaacctggagaagcaaaagaaacccatgaagacttcctagagaattcacatcttcaaggtcaaactgccttaatatttggtgcaagaatattagactatgtcatcaatttgtgcaaaggtaaatttgacttccttgaacggctctcagacgatttgctcctgactatcatttcttatctggatcttgaagatattgccaggctttgtcaaacatcacacagatttgcaaagctgtgcatgtctgataaactgtgggaacagatagtccagtcgacctgcgacaccatcactcctgacgtgagggccctggcggaggacacaggctggagacagctgttcttcaccaacaagctccagctccagcggcagctccgcaagaggaaacaaaaatatggaaacctgagagaaaagcaaccttaggcacacattttcctaccagcagggagctcaggcatggctgtgtttctcttcagtgtccaaatctcttctgtctccttttcttaagaactaagaggttttgttgatgcgtggagccatttgaaactcgtaggggatttgcacacaaatgcagcagagtctggctccccagtgccttgctagagtcaccgtcattctgaggtcaaatcatggcccgaggacaagggctgtaagacagggagccccataggccatcatcatccttatcccacacccattataaaagaggtttctattgtatataaacaaacaataaatgattattagcagg

SEQ ID NO: 345384 - DNA, 1129 bp, Homo sapiens
tgtctgagcgacggcggtggcgtcccaagatggcgtcgtggctgccggagactctctttgaaactgtaggacaaggcccgccgcctagcaaagactattaccagttactggtcacccggtctcaggtaatctttagatggtggaagatctctctaaggagtgagtatcgatcaacaaaacctggagaagcaaaagaaacccatgaagacttcctagagaattcacatcttcaaggtcaaactgccttaatatttggtgcaagaatattagactatgtcatcaatttgtgcaaaggtaaatttgacttccttgaacggctctcagacgatttgctcctgactatcatttcttatctggatcttgaagatattgccaggctttgtcaaacatcacacagatttgcaaagctgtgcatgtctgataaactgtgggaacagatagtccagtcgacctgcgacaccatcactcctgacgtgagggccctggcggaggacacaggctggagacagctgttcttcaccaacaagctccagctccagcggcagctccgcaagaggaaacaaaaatatggaaacctgagagaaaagcaaccttaggcacacattttcctaccagcagggagctcaggcatggctgtgtttctcttcagtgtccaaatctcttctgtctccttttcttaagaactaagaggttttgttgatgcgtggagccatttgaaactcgtaggggatttgcacacaaatgcagcagagtctggctccccagtgccttgctagagtcaccgtcattctgaggtcaaatcatggcccgaggacaagggctgtaagacagggagccccataggccatcatcatccttatcccacacccattataaaagaggtttctattgtatataaacaaacaataaatgattattagcaggaaaaaacaggaaaaaagacccccgcaggagcactcaatgaccggatggcagggacaatcgggggaacatgacacggtgcaacatggggacaacagcgaagctaccgcggacccagcgacctctcatataccaacgtgggcaagactggccgagcccccaaataagacagccctcataaattcagaaacgccgataaccgggataa

SEQ ID NO: 345385 - DNA, 1193 bp, Homo sapiens
  misc_feature (1121)..(1121): n is a, c, g, or t
  misc_feature (1193)..(1193): n is a, c, g, or t
tgtctgagcgacggcggtggcgtcccaagatggcgtcgtggctgccggagactctctttgaaactgtaggacaaggcccgccgcctagcaaagactattaccagttactggtcacccggtctcaggtaatctttagatggtggaagatctctctaaggagtgagtatcgatcaacaaaacctggagaagcaaaagaaacccatgaagacttcctagagaattcacatcttcaaggtcaaactgccttaatatttggtgcaagaatattagactatgtcatcaatttgtgcaaaggtaaatttgacttccttgaacggctctcagacgatttgctcctgactatcatttcttatctggatcttgaagatattgccaggctttgtcaaacatcacacagatttgcaaagctgtgcatgtctgataaactgtgggaacagatagtccagtcgacctgcgacaccatcactcctgacgtgagggccctggcggaggacacaggctggagacagctgttcttcaccaacaagctccagctccagcggcagctccgcaagaggaaacaaaaatatggaaacctgagagaaaagcaaccttaggcacacattttcctaccagcagggagctcaggcatggctgtgtttctcttcagtgtccaaatctcttctgtctccttttcttaagaactaagaggttttgttgatgcgtggagccatttgaaactcgtaggggatttgcacacaaatgcagcagagtctggctccccagtgccttgctagagtcaccgtcattctgaggtcaaatcatggcccgaggacaagggctgtaagacagggagccccataggccatcatcatccttatcccacacccattataaaagaggtttctattgtatataaacaaacaataaatgattattagcaggctaaaaaaacaaacaaactctggcctcgctggactaaacggcggcaccctgaggacgctttcctttaccgaggtgtaattcctggtccccccgtaactgactctgtgcaaccagacccgacactcatgccatgctccatccccttgctacaccgggtgcagaccccctccccacgatcctggcgagcgctccgagcnaagctgcatggcagagcgcccgccaccgctctccgtcgcatcacagcgcaccacacaggcctaccccatgcn

SEQ ID NO: 345386 - DNA, 821 bp, Homo sapiens
tgtctgagcgacggcggtggcgtcccaagatggcgtcgtggctgccggagactctctttgaaactgtaggacaaggcccgccgcctagcaaagactattaccagttactggtcacccggtctcagaaaaattgagtttgcatagccgggcgcagtggcttacgcctgtaatcccagcactttgggaggccgagccaggtggatcacgacgtctggagttggagaccagcctgacaaacatggtaatctttagatggtggaagatctctctaaggagtgagtatcgatcaacaaaacctggagaagcaaaagaaacccatgaagacttcctagagaattcacatcttcaaggtcaaactgccttaatatttggtgcaagaatattagactatgtcatcaatttgtgcaaaggtaaatttgacttccttgaacggctctcagacgatttgctcctgactatcatttcttatctggatcttgaagatattgccaggctttgtcaaacatcacacagatttgcaaagctgtgcatgtctgataaactgtgggaacagatagtccagtcgacctgcgacaccatcactcctgacgtgagggccctggcggaggacacaggctggagacagctgttcttcaccaacaagctccagctccagcggcagctccgcaagaggaaacaaaaatatggaaacctgagagaaaagcaaccttaggcacacattttcctaccagcagggagctcaggggtctacaaattatggcgtggacctaatctgaccagcctcctgatttataaataaagctttattggaacagtattta

SEQ ID NO: 345387 - DNA, 712 bp, Homo sapiens
tgtctgagcgacggcggtggcgtcccaagatggcgtcgtggctgccggagactctctttgaaactgtaggacaaggcccgccgcctagcaaagactattaccagttactggtcacccggtctcaggtaatctttagatggtggaagatctctctaaggagtgagtatcgatcaacaaaacctggagaagcaaaagaaacccatgaagacttcctagagaattcacatcttcaaggtaaggaacggaacatattatatacccctgttaagttctcattagttagtggtagattttgttaaagaagtttcaaatatattttcacttgaaatattgatatgcagttatgtacttacatatacaatgttagattcttaaaaactagaaaactgttgtttttttctcttggaaaacatattagcatttggccgggcgcggtcgctcatgcctgtaatcccaacactttgggaggccgaggcgggtggatcatgatgtcaggagttcgagaccagcctggccaagatggtgaaaccctgtctctactaaaaatacaaaaattagccgggcatgttggcacatgcctgttatcctagctactcaggaggctgaggcaggagaatcacttgaacccaggaggcagaggttgcagtgagctgagatcagaccattgcactccagcctgggcaacaagaacaaaattctgtcttaaaaaaaa

SEQ ID NO: 345388 - DNA, 924 bp, Homo sapiens
tgtctgagcgacggcggtggcgtcccaagatggcgtcgtggctgccggagactctctttgaaactgtaggacaaggcccgccgcctagcaaagactattaccagttactggtcacccggtctcaggtaatctttagatggtggaagatctctctaaggagtgagtatcgatcaacaaaacctggagaagcaaaagaaacccatgaagacttcctagagaattcacatcttcaaggtcaaactgccttaatatttggtgcaagaatattagactatgtcatcaatttgtgcaaaggtaaatttgacttccttgaacggctctcagacgatttgctcctgactatcatttcttatctggatcttgaagatattgccaggctttgtcaaacatcacacagatttgcaaagctgtgcatgtctgataaactgtgggaacagatagtccagtcgacctgcgacaccatcactcctgacgtgagggccctggcggaggacacaggctggagacagctgttcttcaccaacaagctccagctccagcggcagctccgcaagaggaaacaaaaatatggaaacctgagagaaaagcaaccttaggcacacattttcctaccagcagggagctcaggcatggctgtgtttctcttcagtgtccaaatctcttctgtctccttttcttaagaactaagaggttttgttgatgcgtggagccatttgaaactcgtaggggatttgcacacaaatgcagcagagtctggctccccagtgccttgctagagtcaccgtcattctgaggtcaaatcatggcccgaggacaagggctgtaagacagggagccccataggccatcatcatccttatcccacacccattataaaagaggtttctattgtatataaacaaacaataaatgattattagcagg

SEQ ID NO: 345389 - DNA, 617 bp, Homo sapiens
tctcggcacattttctttaattggattctctgtctctttcatttccctaactttgctgagctggttttaagccagcaactctgattttcacttgtgctactcctccatgaattgattattgatgaattaattatccacctatgacctcattcacagtaagtcatgagtaaaaggcacctactcctgttccctgatgtagcccagtagagcctgcaccaatacggctgtggcctgaccagtcactatatgattatgaaaggagatccaacttaaactaaagggaattattttgaacaagattcatcaaaatcagagcacatatctcaccatattcagacagctgaggatagttgtccatccctctactaaccaatcactacctataacacagtctggattctttcgtaattcttggtacatagaagcttctcagaaattatttgatgaaaggatggataaatgaataaataaattattataaacacttgctataagatctaagaataattacactggttgttaagggtgtgtatgaaataacaaaatataatgaatccttaattagtagaatatatttaatgatttccatttacatttatatcaagaaaaaaaaagga

SEQ ID NO: 345390 - DNA, 269 bp, Homo sapiens
tttgattctggctgcctgaggttacccccagcctccagatgtcctagtctcctttctctgggttttgtgctgcggtttctgttgctctgtcttgatcttcactaattgcctgcagtgtctagttctctgtgaatcccatccatggtgtttcattttcaaactttttaaatttttttttatttttagaagtttgacttggattttttttaaatgaaaatctttatctcttcttttttttctatgtatttatcaattaattataattattt

SEQ ID NO: 345391 - DNA, 360 bp, Homo sapiens
aatttacccagaatagcttgttcagattaaatgcacacagtggttgaaaagcaaacttgattctgctccaaaatattctggatgcactttctgaccttctttttctattgtggattaagaaggtgccaaggcgggcagatcacgaggtcaggagatcgagaccatcctggctaacacggtgaaaccctgtctctactaaaatacaaaaaattagccaggcatggtggtgggcacctgtagtcccagctactcaggaggctgagacaggggaatcgcttgaacctgggaggcagagattgccgagatcatgccactgcactccagcctggtgacagagcgagactctgtctcaaaacaaag

SEQ ID NO: 345392 - DNA, 495 bp, Homo sapiens
tggtccatttaccttgataaggtatcattctatacacagtgttcacatggggtagagcctcagggactagtcctaatattttttcaagagcaaagacaggaatttattttatggacatttttggagatggggcgctggcagaaaacatcgtgttcagaaatttctgaagaatgcaaagttgagtgctattgcatgagtcatcctgcagttggttgtttgttatatttttagcaataaagacattccgagctgaagtcgtcctacccagttttcaaagtgctacagcatatggtggcgagattagcccttggggtctcttctccccacactgtgcgagggatttacaccagtcactttaattaatctaatcataaaaataagaatcatgtcattcagaatgtgtggcctcccttttgccaggcatcagtattaatgattctactggcataaattttttgcacatcagtgagagattccaactattagttaaaaatt

SEQ ID NO: 345393 - DNA, 331 bp, Homo sapiens
cagcaccatgtttccatcagttctacttcccacccctatctgcccaagacccacaggggtgatgcagtatgagcctagatgggtgtctgcacgtgcagttggttacattggaggagagaagcactgggcctgaggaatctacaattttatagcagtcagtaaccaagtgtgctctttgtcttaggagatattacctcatctcttaaagttgctggctataaacacaaccctgaaaatgccctggataaagagcaatcagagcctttcattcttatttctagcaggaacgtacagggatgctcagagagaatggtggattgccacttccaac

SEQ ID NO: 345394 - DNA, 495 bp, Homo sapiens
ctatatatatgtgtatatatatgtgtgtgtatatatatatatatgtatgtatttcacaatcttctctactaaataataattctttgggactttttttcataaacacaaatgtctcaaaattaaacacatttaaaaagtattaattcagcctggagaaaaaggctactctgattatacagatattattattgttttcactagcaatagagaatggcattgtctaatgaattcataaataccacatttaatttttacataaaaatggtgttgctaaggtgcatacagagttgtacagggagagagaggcggagaacttaatgttagttgaagtctcactgttgtcttgttgaagctataatttttctttgtagatgcattatttttcacatagaatagaacaccaaacacttttattactcttggattaaagaaaaaggattagctattttttaagtggttagttattttgaattaaggaaattagaactagtgaga

SEQ ID NO: 345395 - DNA, 355 bp, Homo sapiens
tacagaatcaatctaagtgtccatcaatggatggttggataaagaaaatgtgatgtgtgtatatatatctgtcacatttcatggcgagatatatatatcacatttcatggtgtatgtatatattcagccattaaaacagggtgaaatcatgtttcttgcagcaacatattaatagatgggactagaggtcattatcttaagtgaaacaactcagaaacagaaagtcaaatactgcatgttctcacatataagtggacctaaataatgtgtagaaatggacatacagtatggaataatagacactggagactcagaagggtgagagggagttgagggctgtgaaattacttaatgg

SEQ ID NO: 345396 - DNA, 686 bp, Homo sapiens
gtttcaccatgttggccatgctggtctcctgacctcaggtgatccacccgcctcggcctcccaaagtgctaggattacaggcgtgagccactgcacccggcctgaatcacgtttaatagtagtgagcatatcaatctggttattgggactattaagacttttgtgactttaaaacaaacaatttttttttgttgttgagattgtgtgttgctctgtcgcccaggctggagcgcagtggtgcgatcttagctcactgcaacctctgcctcccaggctcaagtgatccttccgcctcagccttctgagtagctgggactataggtgtacaccaacacgccaagataacttttatattttttgtagagatggagttttgccatgtcacccaggctggtcttgaactcctggactcaagcgatccacttgccttggcctcccaaagtgctgggattacaggcatgagccactgcgcccagccagtgacttttaaaatatttttctgaataaaatatagcatgcattgttaaaaaaaaacctataaaatacagaaaacataaaactaatgaacttttaatattattgctgataaccttgtggcacgttcacatactcagacatagttttacatagttcagactatattatccagttttgtacccagttagaaaattataagcatcattcca

SEQ ID NO: 345397 - DNA, 841 bp, Homo sapiens
tcaagggtttatgcataggagtaagagaaaaatgatacttgtagcccttacaattgtatgactatcctgaacactcctaccgttattcataaaacttttattatgatgtagttgtgctcaaatacttccgagtgcttaccatgtcttgtatacctatgttgttcattacagtagccactagccacatgtggccattaagcacttgaaatgcggctagtccaaattgaaatttactgtaagtgtaaaatacacattggattttgaagacttaattaaaaaatagcatgtaggccgggcacagtggatcacctgaggtcaggagttcgagaccagcctggccaacatggtgaaaccctgtctctaccaaaaatacaaaaattagccaggtgtggtggtgcacgcctatagtctcagctactcaggaggctgaggcaggagaattgcttgaacccaggaggcggaggttgcagtgagccgagatcatgccactgcactccagcctggggcaacagagtgagactctgtctcaaaaaaaaaaaaaaaagcatgtaaagtatctcattaatttttaaattttgaatacatgttcatatggtaatatagtatttgataataaggcagtagtcattttctcaaggcctccatcataaaaatgcagatgactatttatatttttttgtgaatttctcggtgtaaataattccccaaatgatcatactttatattctccggactgcgtgcctcgatgtttgtttgtgctcttgtactggccctccttttctttaatgcctagctcttctaattcatcatagtccttagtttctttttccttgagctgaac

SEQ ID NO: 345398 - DNA, 552 bp, Homo sapiens
ggatctgccgcctcagcctcccaaagtgctgagattacaggtgtgcaccaccatgcccagccgagaagtgaaatttaatgttattaaggatgaggtcatactggaggtggtaggcccttaatccaatgtgattggtgtcatcacgagcagacggccactgaagacacagacacacagggagagcactgtgtgatgactgaggcagggattgagccatgcagctgtgaggaaccccaaagcatgccagccaacccccagaaccccaggcaaggcaaggaagaactcccctacaggtttcagagggagcatggtggacaagctgactttggacttctggacaacagaactgtggttttgttttcagccacctagttggggatcagcccttagaaactgagacaatgcccaactcaggccctggctcttttccacgcacagagtgagagagctttaaatatacaaagagatggctctccaaagcctcccacaatagactgaccatctcacccagccaatctttctggacccaaagtggatttcgtaaccaatttc

SEQ ID NO: 345399 - DNA, 126 bp, Homo sapiens
acacacacacacacacacacacacgcacacaagtacctaaactaatacaactaataaatgattttagcaagattgtatgatttaacatcaatataaatatcatttatgtttctatacaataactac

SEQ ID NO: 345400 - DNA, 404 bp, Homo sapiens
cccctggtggcctgtgctcagggcacctgagggatgcaatggacagtgaggctggaacagatgatggctgtgcctcccatgttagggtagggactttgggctttatcttgcaggtagggagcctttgaaggttttttgacaatgcccagggaggttccattagcttaggggaggaggagcaggaagatgagaacatgaggagtttagtgtgggatgtgttgagtttgaggctctgtggaacatccagtggttgccttgtggtaggcagttggatttatgagccaagactcaggaaaagttctggactagggttagagatctgagaggtattggtagttgatagttagaggattgactatgaatggaactgtacaggccaggcacagttactcacacctttaatc

SEQ ID NO: 345401 - DNA, 988 bp, Homo sapiens
cccacctccactccccactcatttttaatacccgtgcagtggggaattgatactgtggttttcaatgtcacccacactgcagcacggccacagtcaccatcccgatttttgctacaaatgaaaattactttataatgagctccttaacacttttctttaaacctgtgtttggaagacttgcgttggtgtggccctgtgcccaatacctgtgaaatcacagcaccgatgagctggttccaatttttaaaatatatacatgcagtacttccatgactattcaaagaaaaacaattccttccatttgccatctgagatgaccaccagtggtgtgaactacctcctgcccccatctgcagtcccaggatcctgggacagggcttatgaacacaaccactgtagtcagctcacctgatccacagcctggcacccccactgtctggctagggagcctcgaatgggtcccaaggccaccctgctcctcagttacatcatctgcatagtagtggtggttgtgaggaattcaggagctgcagcataagggctcggcaggtcctaagtgcacagtaaatgccagtgattcttaagagtctgagctcccattgtagaggcaagtaagctgaggttcagagacagaaaatgacttgcccaagatcacccagctgggaagtgacagtgccagggttggagccctggttgagctggttccacaggccagagctcattctgccctctccccggaagacctcccaccctgtccccatgcctctgcttctccctcaccccaattccccgctgccttctaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagc

SEQ ID NO: 345402 - DNA, 1257 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagcacaaaacaaaaaaaacaacaaaacaaaaacaatttttggggcggcttggccctgaggagagcttttgcaaaacccctcttggtgggggcgcgggcgccaagaaaggtaacgtgcaaacgttgcgcactaaagcgggggttccccaagagaaagaccctggggcgcaaagaacacagcggcgtggggcctccctcccaaattaaaaaaccgccgggggggacaccggccgcgttctgtaaacaacctccagaaggagagactaggcggaccaaccgggggcctctacagggcgggggcccacgaggagagcgaaaataaaacgccggcgccgtgtggtggggtc

SEQ ID NO: 345403 - DNA, 743 bp, Homo sapiens
  misc_feature (31)..(31): n is a, c, g, or t
  misc_feature (35)..(35): n is a, c, g, or t
  misc_feature (38)..(38): n is a, c, g, or t
  misc_feature (42)..(43): n is a, c, g, or t
  misc_feature (46)..(46): n is a, c, g, or t
  misc_feature (53)..(53): n is a, c, g, or t
  misc_feature (60)..(60): n is a, c, g, or t
  misc_feature (62)..(62): n is a, c, g, or t
  misc_feature (66)..(66): n is a, c, g, or t
  misc_feature (83)..(84): n is a, c, g, or t
  misc_feature (99)..(99): n is a, c, g, or t
  misc_feature (108)..(109): n is a, c, g, or t
  misc_feature (130)..(130): n is a, c, g, or t
aaggtttttgaaaaaaaaaaaaaccgccganccantangccnntcngggtctncaatctnanctcnaccttgctgaagccagnnccattgtgtccaacntagtcgggnnccatcacaacgcaccctgacnagatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagc

SEQ ID NO: 345404 - DNA, 765 bp, Homo sapiens
ggggatttttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagc

SEQ ID NO: 345405 - DNA, 350 bp, Homo sapiens
cagaacgtgggaggccaagaggacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagc

SEQ ID NO: 345406 - DNA, 1261 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagccagagcgggactttaccttcattaaacctctgcaaagctaaccatgaattcttagtctactgtgaaaatcgatggggtctggacacatgcgatggactgagttacagaagagacttgatggcagcgaaagatgtcatgaagaccaccggggattgcggactccacgacacgatttaggaccaaactgacgtactaactgggaccacacgaaataacgatcggcgaaaggcaaaggagtcagttgacaacacacacaagacgcccgcgcgagaagcactagcttgtcaccacgaacagtggcggggagagacgaaacggcaacaagcaaggacacggaccctaaatag

SEQ ID NO: 345407 - DNA, 1078 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagccaaaaaaaaaaaaacaaattgtcggcgccccggaaaatttaacactccgtgggccgcccaagaaaaaggaacgtcgtccagacccgctcgaggcggcccaaaaccggggcggcgacacaagtcgttcttcaccccccccccctcccgcaaacaataacccccaa

SEQ ID NO: 345408 - DNA, 845 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaagcgggtaagtccgtaccggacacaggctgggagcagggcagagaactggggggccatggttgcgcgggcaggcggacatgtggaccttaacgtgtttccttcggtgcgcataggggg

SEQ ID NO: 345409 - DNA, 828 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggtaaacgcaagggattggacagtgcccaccttgtccatggcccaacttgggcagccccagaggcccagagcaggagagctgccaggcaaggctgcacag

SEQ ID NO: 345410 - DNA, 824 bp, Homo sapiens
gatagatgattggttcgacgtgcgtcctgagtctcgtaattgaacatgtgtctgtagtctgttacactagcgtaaatccttggtacactcatgtatgtgaattgccatacttcacactagtgtgacaacgcctcaggtagcgcgagatgcgcaatgcttctgaaagcacaatcctggatgcgaagattcatgtgggctcaattggcttgtgaatctatcaaatcagggagttctcagaagacgcaggacgtcaggataatcataatgtacggcctcgggactatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagc

SEQ ID NO: 345411 - DNA, 855 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagc

SEQ ID NO: 345412 - DNA, 860 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggtgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagc

SEQ ID NO: 345413 - DNA, 960 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttactttacccccaacaagacagaggacacgatctttctcagagagtaccagacccgccagaaccagtgcttctataactccagttacctgaatgtccagcgggagaatgggaccgtctccagatacgagggaggccgagaacatgttcgctcacctgctgttccttagggacaccaagaccttgatgtttggttcctgacctggacgatgagaagaactgggggctgtctttctatgctgacaagccagagacgaccaaggagcaactgggagagttctacgaagctctcgactgcttgcgcattcccaagtcagatgtcgtgtacaccgactggaaggagggggaatcctagcaggacacagccttggatcaggacagagacttgggggccatcctgcccctccaacccgacatgtgtacctcagctttttccctcacttgcatcaataaagcttctgtgtttggaacagttttaaaaacacaattatttttctctattgtggactaattacatttatttaagtttatttgtaaaatgttatagggctaaaattctggggggggggccg

SEQ ID NO: 345414 - DNA, 929 bp, Homo sapiens
  misc_feature (787)..(787): n is a, c, g, or t
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgccagaaccagtgcttctataactccagttacctgaatgtccagcgggagaatgggaccgtctccagatacgagggaggccgagaacatgttcgctcacctgctgttccttagggacaccaagaccttgatgtttggttcctgacctggacgatgagaagaactgggggctgtctttctatgctgacaagccagagacgaccaaggagcaactgggagagttctacgaagctctcgactgcttgcgcattcccaagtcagatgtcgtgtacaccgactggaaggaggataagtgtgagccactggagaagcagcacgagaaggagaggaaacaggaggagtnggcatatcttcccggtccgctcttgtgtctatactgacactttagggtcgctttcttttgtaacacgttatgtagacctacagtgtttcacttctagtaccaatggaagtttgatatctggccctatcgagatttttaaatg

SEQ ID NO: 345415 - DNA, 802 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgccagaaccagtgcttctataactccagttacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggccaaaaaaaa

SEQ ID NO: 345416 - DNA, 943 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttactttacccccaacaagacagaggacacgatctttctcagagagtaccagacccgagggaggccgagaacatgttcgctcacctgctgttccttagggacaccaagaccttgatgtttggttcctgacctggacgatgagaagaactgggggctgtctttctatgctgacaagccagagacgaccaaggagcaactgggagagttctacgaagctctcgactgcttgcgcattcccaagtcagatgtcgtgtacaccgactggaaggaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagttttaaaaacacaattatttttctctattgtggactaattacatttatttaagtttatttgtaaaatgttatagggctaaaattctggggggggggccg

SEQ ID NO: 345417 - DNA, 915 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggcagtgaagcagtccggccttgggcgagaggggtccaagtatggcattgatgagtatctggaactcaagtatgtgtgttacgggggcttgtagggattcttgtggttctttaagaaaaagtttcacaaggagacttatctacatatataggtacatgccatccattattcttaaataaactaataggttttcagaagcaaaaaaacaaaagcaaaacacgcaacacagaaacaaaactgtgcggggggcgggccttgggccctctgaaaaagccttcttaaaccccaattctggtgtgggcgccgggggccccactagggctcgggcaacaagggcgcaaaccgggccccccaaggggacccccggggcacgaaccacgggggggggccttcccccaacgagcaaaaaggcgcgggggcacccggg

SEQ ID NO: 345418 - DNA, 953 bp, Homo sapiens
agcacggccacagtcaccatcccgatttttgctacaaatgaaaattactgtataatgagctccttaacacttttctttaaacctgtgtttggaagacttgtgttggtgtggccctgtgccctaatacctgtgaaatcacagcaccgatgagctggttccaatttttaaaatatatacatgcagtacttccatgactattcaaagaaaaacaattccttccatttgccacctgagatgaccaccagggatgtgaactacctcctgccccatccccagccccaggatcctgggacagggcttatgaacgcaaccactgtagtcagctcacttgatccacagcctggcacctccactgtctggctagggagcctcgaatgggtcccaaggccaccctgctcctcagttacatcatctgcatagtagtggtggttgtgaggaattcaggagctgcagcataagggccctgcaggtactatgtgctcagtaaatgccagtggttcttaagggtctgagctcccattgtagaggcaagtaagctgaggttcagagacaggccctggttgagctggttccacaggccagagctcattctgccctctccccggaagacctcccaccctgtccccatgcctctgcttctccctcaccccaattccccgctgccttctaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagttttaaaaacacaattatttttctctattgtggactaattacatttatttaagtttatttgtaaaatgttatagggctaaaattctggggggggggccg

SEQ ID NO: 345419 - DNA, 914 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagc

SEQ ID NO: 345420 - DNA, 820 bp, Homo sapiens
ccgagctaaagagaaaagaagggaattaaaggtttccacttcctcgtgccgaattcgggccgaagccctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagc

SEQ ID NO: 345421 - DNA, 888 bp, Homo sapiens
gctgtctctcctgctgtcttgtgaagaagggacttgcttcctctttgccttccaccatgattgtaagtttcctgaggcctcccagccatgtttcctctgaagcctgcggaactatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagccaaaaaaaaaaaaacaaattgtcggcgccccggaaaatttaacactccgtgggccgcccaagaaaaaggaacgtcgtccagacccgctcgaggcggcccaaaaccggggcggcgacacaagtcgttcttcaccccccccccctcccgcaaacaataacccccaa

SEQ ID NO: 345422 - DNA, 984 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagccaaaaaaaaacaaaacacaaaaaaaaagaaaacacttttgggccacgccacggccctaaaaagctctaaa

SEQ ID NO: 345423 - DNA, 978 bp, Homo sapiens
  misc_feature (55)..(55): n is a, c, g, or t
tatcatacgagtgtatgagttgtagaagaaatgaaagaagagttaggtgtcagcntaggatggtaccttgggttatgacggaccaaatccttcttggagggaaggggactgctaagcatgtccctcccagggacatccccgcttgctggcctaatagcagagcttaacacacaggatgggagcaggcagtgctgagctggttttctaagtccggagtcttaacaggtgctttggggttgccgctgaatagaacaggctaaggtggctttggaagcattttgcaagaccacgcccaggccgccaagcttcggtttcattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagc

SEQ ID NO: 345424 - DNA, 835 bp, Homo sapiens
  misc_feature (764)..(764): n is a, c, g, or t
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaagggtgctagcgggacacgggcgtgggatcagaccgnagacttgggggcggtcctgggggtggagggcgggaggtgcgctagcggggtgccggacgtgtcgtgggggg

SEQ ID NO: 345425 - DNA, 762 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcctccagtggctcacacttatcctttttccaatcggtgtacacgacatctgacttgggaatgcgcaacggtcgaggtcg

SEQ ID NO: 345426 - DNA, 960 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgccagaaccagtgcttctataactccagttacctgaatgtccagcgggagaatgggaccgtctccagatacgagggaggccgagaacatgttcgctcacctgctgttccttagggacaccaagaccttgatgtttggttcctgacctggacgatgagaagaactgggggctgtctttctatgctgacaagccagagacgaccaaggagcaactgggagagttctacgaagctctcgactgcttgcgcattcccaagtcagatgtcgtgtacaccgactggaaggaggataagtgtgagccactggagaagcagcacgagaaggagaggaaacaggaggagggggaatcctagcaggacacagccttggatcaggactccctcacttgcatcaataaagcttctgtgtttggaacagttttaaaaacacaattatttttctctattgtggactaattacatttatttaagtttatttgtaaaatgttatagggctaaaattctggggggggggccg

SEQ ID NO: 345427 - DNA, 990 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaagggctaacgtgtgagccactggagaagcagcacgagaaggagaggaaacacggaagtggtgaacaatctaaaagaagagaaaggttgttggccaagtatctttcgattcaactgtccaacaatagtccaccgaatatgattgggtccaccgcggttgattattctatcgcttccacaagcagtggactggctttggatccaacgtgggcacggcagaagggaaggagttcattacaaccggagccgcgttgctaccgacacggttaagaacatttcacgggccaagctgacatgaatctacccttgacaaatatgcctttggacacaacacag

SEQ ID NO: 345428 - DNA, 964 bp, Homo sapiens
ggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgagaaaccgacaaggacacaagatgcatctataaaaaaaacataaacatgaaatgataccagcggagaaaaaatggggacagtcatacaagatacgatggagagagccaaagagcatattagaaacacttgatgaataaaatcagggaaaacaaaagaactaaaatgattgaataatgaaagtagaaacgaatgagaagaaatggagggctgaatagactaatgactagaacaaagacaagaagacgaaacaaggagacaaataggaagaagtactaacaaaaacacaacggaatgatatgaaacaatataaccagagtcagaatgtacgagatacaaccagaatagaaaaaaagaaaaaaatgaaaccaaaggagaaaacaaacagaaaaggaaaagaaaacacggaggaggggaaaaacatagaaagaaacaaaaataggaaaccaagaaaaagacatgaagagacaaacaagaacaaccaacacgaaaggagtaaaaaagaaaaaccatcaaagcg

SEQ ID NO: 345429 - DNA, 445 bp, Homo sapiens
aaatagcatttacgtgacagtgacttcagtctgtcttctttcctcctttgtccttccctgaatttgaatctctaaatctaggacatgaattctagagtgggagggatgagtaaaccaacaaggtaacaaaagcataagtaagagcaatgtcaatcagaggcatctatgctgagctggaagtcttccagcaggacactgctagaggggaccagtagtgccttttgggcaggaagtggtatttcagttgtactatgaagggtgagagttagatttgtggaaggacctggattagcaaaacatttgggttcgagagtatagagattgctcagggtgcagtagccagttgaccagcaggttacatgaagcgggtgttgcctggagaagcaggaaagctgttgggtcagaattgtggagagagatggatagggggcaggttattaagcct

SEQ ID NO: 345430 - DNA, 526 bp, Homo sapiens
tctggaacatagggccagaaagatttgtaagatttggttcctactctcaagaaactgggattccgattatctgcaaaaaatcatattcctgaaatcagattccctaaatgaaagcaagtccatatggtataagcccttggtacattttaagccgaggatacctttcctacctcccaaacctaagattataagagtggccaccagagccctcaccctggtctatttccttctacaacactggccagcacattcatagaacctggttgcagagataagtcaaatcactgcaaacttgggatggccaacgccccatcctagcttctctagattcctttgcagggatgtccacagggtgcttttatatatgtcttcatgccctcctgcttcgtctactcttcatgccccatctaagtgtttttgaaaaatgaaatacttaagttagaaaaccagacttagcaagttgtacttccaaaagcagcaatcatttcagtaaataaacattttctgattgagaacattaattcag

SEQ ID NO: 345431 - DNA, 109 bp, Homo sapiens
agataacgctatagagaaaacactgtttactgaacagtgctttgaaaccacgagggtgatcagagccccatttcgccttctagagataaacctgtctcccttcctgcag

SEQ ID NO: 345432 - DNA, 453 bp, Homo sapiens
aattgtgtggcttcctcgcaaaactgcagggccagggaatttcttattctcatcctagttcaaactctacctgcagaagttaatcaaattttgcattttaggtttctgttcaatccacagcttcttctccaggtttttcttgctgaaagaatgtgagtgatgacttcaaaaatttttacacacggacctgaaactattctctacagacggtgcagcctaatatctcccagactagcacttcccatggccctgcacttggggcctcactgcctggtagaaatgaagatttaactgctgtgccatctcttctaaatctggagtggattttttgttgtttgtttttatgtttttgttcaattggctatttctgagatgaatgacaaatttccttgattccattgtatatcaatttatactataatatctataataaaatgttgacaatgataaatt

SEQ ID NO: 345433 - DNA, 376 bp, Homo sapiens
gcatacattcatttaattgttaacttatttattcagtaagatcttactgagcatttgctatgttctagatatcggtgtcacatcaatgagtaaactggatttgttgccagttgtcatcaaacttaagcaaatagggacgagacacaactaaatgagacattgtaagacacgatgataagtgctacagcaagagaggtcaagttcatggaagctcagagccctcagtgcagtcaaggggagagagtccagcgctatgctgcccagcatggtaacgatgaacacatatgactgttgaatgctggaaatgtcactaatcccaatggagctatgttttatgaaatacacatagactatcaagatgtaatatgcaaaaaaa

SEQ ID NO: 345434 - DNA, 461 bp, Homo sapiens
gcacttcttcctttggctgatttaaacttgcatgcttactatataataaactgcaaccatgagcatagtggttttagtgagttctgtgagtctttcatcaaacctcagggtggttttaggaatcccttgaaattgcaattgttgacagaaatgagggtggtcttatgggaactgttttccccctaactgtatcgctggcatctgagacaacaagaacacccttgagtgattcctctcctcttgggtatgagagggacctttgacttgcttccaatcaatagaatacagtacaggcaacggactgtacataattatgtgtatgtaattgtgttaaacaagtttgtagcactcctcttgctggagtacctcccttgctggctttgaagaatcgagctactgttgtgggctgcctatgttgggaggctcacatggtaaggaactgaagacagcttctaggaact

SEQ ID NO: 345435 - DNA, 1004 bp, Homo sapiens
aattttgtaaaattttgatttggtttcttggttgtccatagctcagaagtacaaatacctgtctatatatgctttatgaggatgttgccatatgcatctttcatattttgtttgaaataaaagtaaaaattatgagaaatagttgctcagagttggcttctgaggttgctttttagaattcagctgttttaaaatggtattactctttttgagtcaagttctgggctagttgtccacaagattcaaatgaggccaaaccaaacatgttttgaaacattaaagtacaggaaaggcctcttaatagttcattctctccttctctttcagagtaaccagaataagttgttactaaatttaattttaaagaatagactgttcctgtaccgaaatctgccaagttgctacagaaatatttctttttaaagagcagaaatgtgtttatgatcagcccaaagtagtaaagatgaaaagtgacttaaatgtaaatgctgtcttaaagaaatgcttgtcataagccccaaaaccttccagagtgtttcaggaagacttacacaaaacctttttgaattgtttagtaaattttatcatgtgaccttttttatgagtgtaagactgaattattgaaagacctcatagcacaagggagccatgctgccagagtttgaatcttaccaccatccctcactggctgtgtgaccttggggaacgtttctaacctggcttttgtgggttttgtcctgtagatggaaagaatgacttctcaaggggttgttgtaaggttgcatgagagtacatgtcacagagcactccaggttagctaccccatcatcaccagcagtcttagagaggtgtctagtgtagtggttaagagtaggacctcacgctggttcatgcctgtaatcctagcactttgggaggctgaggtgggaggatggcttgagctcaggaatttgagaccaacctggtcaagatggtgagatccggtctctacaaaataattaaaa

SEQ ID NO: 345436 - DNA, 212 bp, Homo sapiens
cagaagccttttccctcaaaatagcaattagcatcccaggaaacacccttgggacagcctagaccagataacctctcaggctctgtctgccacgttactccacactctagctgcagggagctgaggcagctgctggccagcgattcccaagatcctgggggaagggccaggcggcgcccagagaaggctccctcagggaatggtggcagctg

SEQ ID NO: 345437 - DNA, 193 bp, Homo sapiens
ttttcctgaatgtgtccaatttgcaccatctctcccacagaggacaaataaaaaaatctcgcattacttaagaattatttcgtggcgtgtgtctctccagacttttgttatggtgtcactacttgcaagctgtgagtctgttttgagaactctctccatctctccaaataaaaacatatcagaacagtgatgg

SEQ ID NO: 345438 - DNA, 2786 bp, Homo sapiens
ctttctccttctctgtctcactctctctctttctctccctctcctatcggagcacaatgaaagcctgtgtatcgccgtgactccgggcgggagccagtgtcagcaaagcggctaacaacagacgagaaagagaaaggaaaatacaagctactttttttttccatctataaagcggagcaaatacaggagatagaaccagattgcttattgcgagtccagaccctcagatccactggccggggatggaatgtacaaaagtggacagaaaagtggctggacatgactcggtgcaatttgctggaagtttgtaagtttgaccatcgtttgtaaattactctcggaagagtttgtctctcttgatactgtattagaatagagccgggggtgaggaatagaaacgtaagcgggaaagaaaaaaatgtgttgaaggatctctctcagtggctagcgacttaagattgcttttcatttaaggctaggaaaccttagagggagtgaggattttaccggtgattggattagctgaagaaaaaagcatggtccaaaagtccaattactgacattgttaacagttgaaaagctgtctccctcttttgggagaagacaacatcctacagtaccccaaagaggagaaaacaccggagcgaaaggaaagggaggaaaaattaaaagccaaaagacagtctcccttgatttttgcacattttgaacagtgacttaaacatcttctgaaacagcactgttttgttttgttttggttttttatttaacctgaggaaaagtcaaggctgctggttacatagacatggtagaaatgtgtttctctgcagaaacatccccataaagaattgtcggaaacaactaggtgagggggagtcctctctattaatacctctctcaataccttttgctgtgtgtttctgtctcttgctggacaatccctgaattcttgatctaacccccagatcgtgtgtttacaaagtacctagtggctcttgtcagcttggtggaggaaaaaaaatccaccaactctgtccaacttctccagagctgtcaaatgcaattagagtaagttaatcagggtttgtttccaacttatcctccccccagttggtttctattctttctccccaccctctttttactaactcccctcccccacaacttctccacggctcccccacaacctctgaagacctctattcatgtggccctgaacactgagctcacattgtcaaaaacagacttgcctgcaatagccagcagtagcctctttccacctcaccatcccagaggcagcaatcattgtgtccggtaagatgggggacacagcgcccccgcaggcccccgcaggagggctagggggggcctctggggcggggctccttggagggggctcagtcaccccgagagtgcacagtgctatcgtggagcgcctccgggctcggatcgctgtctgccgccaacaccacctgagctgtgaaggacgatatgaacgaggtaggccgagagctcagaccgggaaagagaaagcaccttgcagctcctgagccttgtacagcatggccagggggcaaggaaagctggcaaacacaccaaggccaccgccactgctgccaccactacagcccctccaccgccccctgctgcccctcctgcggcctcccaagcagcagcaacagcagccccaccgcccccaccagactatcaccatcaccaccagcagcacctgctgaacagtagcaataatggtggcagtggtgggataaacggagagcagcagccgcccgcttcaaccccaggggaccagaggaactcagccctgattgcggtaagcacctggctttctcatggttctggctgtggtcctgtgaccttttgtgagggtagagtttgctttggcctaaggtagagtggatggcaatgaaaaaggccaagatgtcacctgactaccttaaaggccattgggtgtgttcgggtggtttcatgcgcctactcatcatgttctgttggtgctcactcctgggttttccttcgcttataggatattccttaactgataagaagcctgagttttccagaggctctctggggtccacatcttataaaagaagaggctaccagctggcaagatctgagccactgaggaaggttctatctcatggatcctccagctttggccagccagctctgattaggcccccaagccatttttcagccccaaagcatttatcagcccagctggcctttattaaagcctttttctccttgccccatttcccctctcccttttgaagtgacccccttcttcttcgcttaagagaacataaatggtaagctgtaacaaatagcaaattccccgaatgtcccctcagtcaaaaacaaaatttggggaaaatatcccaaagagagactagggaggcactgtttcttaagaggcctactctctgattccctctagactctctcactcctgagccacatctcgattattttcccaagcactccagtccaatccagtaatgctcccttagagcattcgttaagcagacaggcacgaagcagctatttacacagatcatcatcctaggaaataccttgtcttcagccactcctggtgataggatatcaaacccaaaagttctgattaagtttctggctggaagttcttccccagaggcacagacacacaccatcccagaggagtatcccttggatcattgattctcagtgccagtcctggtcaggtgactgcctgctgtttgcaggcttccccccaaagctgc

SEQ ID NO: 345439 - DNA, 5488 bp, Homo sapiens
ctttctccttctctgtctcactctctctctttctctccctctcctatcggagcacaatgaaagcctgtgtatcgccgtgactccgggcgggagccagtgtcagcaaagcggctaacaacagacgagaaagagaaaggaaaatacaagctactttttttttccatctataaagcggagcaaatacaggagatagaaccagattgcttattgcgagtccagaccctcagatccactggccggggatggaatgtacaaaagtggacagaaaagtggctggacatgactcggtgcaatttgctggaagtttgtaagtttgaccatcgtttgtaaattactctcggaagagtttgtctctcttgatactgtattagaatagagccgggggtgaggaatagaaacgtaagcgggaaagaaaaaaatgtgttgaaggatctctctcagtggctagcgacttaagattgcttttcatttaaggctaggaaaccttagagggagtgaggattttaccggtgattggattagctgaagaaaaaagcatggtccaaaagtccaattactgacattgttaacagttgaaaagctgtctccctcttttgggagaagacaacatcctacagtaccccaaagaggagaaaacaccggagcgaaaggaaagggaggaaaaattaaaagccaaaagacagtctcccttgatttttgcacattttgaacagtgacttaaacatcttctgaaacagcactgttttgttttgttttggttttttatttaacctgaggaaaagtcaaggctgctggttacatagacatggtagaaatgtgtttctctgcagaaacatccccataaagaattgtcggaaacaactaggtgagggggagtcctctctattaatacctctctcaataccttttgctgtgtgtttctgtctcttgctggacaatccctgaattcttgatctaacccccagatcgtgtgtttacaaagtacctagtggctcttgtcagcttggtggaggaaaaaaaatccaccaactctgtccaacttctccagagctgtcaaatgcaattagagtaagttaatcagggtttgtttccaacttatcctccccccagttggtttctattctttctccccaccctctttttactaactcccctcccccacaacttctccacggctcccccacaacctctgaagacctctattcatgtggccctgaacactgagctcacattgtcaaaaacagacttgcctgcaatagccagcagtagcctctttccacctcaccatcccagaggcagcaatcattgtgtccggtaagatgggggacacagcgcccccgcaggcccccgcaggagggctagggggggcctctggggcggggctccttggagggggctcagtcaccccgagagtgcacagtgctatcgtggagcgcctccgggctcggatcgctgtctgccgccaacaccacctgagctgtgaaggacgatatgaacgaggtaggccgagagctcagaccgggaaagagaaagcaccttgcagctcctgagccttgtacagcatggccagggggcaaggaaagctggcaaacacaccaaggccaccgccactgctgccaccactacagcccctccaccgccccctgctgcccctcctgcggcctcccaagcagcagcaacagcagccccaccgcccccaccagactatcaccatcaccaccagcagcacctgctgaacagtagcaataatggtggcagtggtgggataaacggagagcagcagccgcccgcttcaaccccaggggaccagaggaactcagccctgattgcgctccagggttccttgaaaagaaaacaggtagttaacctatctcctgccaacagcaagcgacccaatggctttgtggacaactcatttcttgatatcaaaagaattcgtgttggggagaatctctctgcaggacaaggtggcctccaaataaacaatggacaaagtcagattatgtcagggaccttgcctatgagccaagcacccctgcgaaagactaacactctgccatcccatacacattctcctggcaatggcctgtttaacatgggcttaaaggaggtaaagaaggagccaggagagactctgtcttgcagtaagcacatggatggccaaatgacccaagagaatatttttcctaataggtacggagacgaccctggagaacaactgatggatcctgagctgcaggaactgttcaatgaactgaccaacatatctgtgcctcccatgagtgaccttgaactggagaacatgatcaatgccaccataaagcaggatgacccatttaacattgacttgggtcagcaaagccagaggagcacacctaggccctccttacccatggagaaaatagtgatcaaaagtgaatactcaccgggcttgactcagggcccctcaggctctcctcagctgaggcccccatcagctggccccgcattctccatggccaactctgccctctccacttcgtctccaatcccttcagtccctcagagccaggctcagcctcagacaggctccggagcaagccgggccttgccaagctggcaggaagtatcccatgcccagcagctcaaacagatagctgctaatcgtcagcagcatgcccggatgcagcagcaccagcagcagcaccagcctaccaactggtcagccttgccctcctctgctggaccatcaccaggtccatttgggcaggagaaaatccccagcccttcttttggtcagcagacattcagcccacagagctcccccatgcctggggtagctggcggcagcggccagtcgaaagtaatggctaactacatgtacaaggccggcccctcagcccagggtgggcacctagatgtcctcatgcagcaaaagcctcaggatctcagtcgaagttttattaacaacccgcacccagccatggagccccgtcagggcaacaccaagcctttgtttcattttaactcagatcaagcgaaccagcagatgccttctgttttgccttcccagaacaagccttctctcctacactacacccaacagcaacagcagcaacagcagcagcagcagcagcagcagcagcagcaacagcagcagcagcagcaacagcaacagcaacagcaacagcagagttcaatttcagctcaacaacagcaacagcagcagagctcaatttcagcccaacagcagcagcagcagcaacaacagcagcagcagcagcaacaacaacagcaacaacagcagcagcagcagcagcaacaaccatcttctcagcctgcccaatctctaccaagccagcctttgctaaggtcacctttgccacttcagcaaaagctcctacttcagcaaatgcagaatcagcccattgcaggaatgggataccaagtctcccaacaacagagacaggatcaacactctgtggtaggccagaacacaggccccagtccaagtcctaacccctgctcaaatccaaacactggaagtggttacatgaactcccagcaatcactgttgaatcagcaattgatgggaaagaagcagactctacagaggcagatcatggagcagaaacagcaacttcttctccagcagcagatgctggctgacgcggagaaaattgctccacaagatcagataaaccgacatttgtcaaggccacctccagattataaagaccaaagaagaaatgtgggcaatatgcaaccaactgctcagtattctggtggctcatccacaataagcttaaactctaaccaggctttggcaaacccagtttcaacacacaccattttaactcccaattccagcctcctgtctacttctcacgggacaagaatgccatcattatctacagcagttcagaatatggggatgtatggaaatctgccttgtaatcaacctaacacatacagtgtcacttcaggaatgaatcaattgacccaacagagaaacccaaagcaattgttagcaaatcaaaacaaccctatgatgccacggccacctaccttagggccaagtaataataacaatgtagccacttttggagctggatctgttggtaattcacaacaattgagaccaaatttaacccatagtatggcaagcatgccaccacagagaacatcaaacgtaatgatcacatccaacacaactgcaccaaactgggcctctcaagaaggaacaagcaaacagcaagaagccctgacgtctgcaggagtccgcttccccacaggtacacctgcagcctataccccaaatcagtcactgcaacaggcagtaggtagccagcaattttcccagagggcagtggctcctcctaaccagttaacaccagcagtgcaaatgagacccatgaaccaaatgagccaaacactaaatgggcaaaccatgggtcccctcaggggtctgaatctcagacccaatcagctaagcacacagattttgcctaatttgaatcagtcaggaacagggttgaatcagtcgaggacgggcatcaaccagccaccatccctgacgcccagcaattttccttcacccaaccaaagttccagggcttttcaaggaactgaccacagcagtgacttagcttttgacttcctcagccaacaaaatgataacatgggccctgccctaaacagtgatgctgatttcattgattctttattgaagacagagcctggtaatgatgactggatgaaagacatcaatcttgatgaaatcttggggaacaattcctaaagaagaaagggaagacaatttacaaactccaagcactaaaaggcagtatattacagaaactctgtagaggctgaactgttgatgttcaggtggactacatgaagataacatgcttaaaaatggaaagcagaaagtaactgcagtgatgaacattttggtccaaattcttgttttaaatcttacacctgaaagtaaaatattgggatcacttttccctgtctaaactccaggatacagtatccaatttatccaaacagaactgtggtgtcaatgtgtaattaattgtgtaaaatagccttcccaagtttctttttccctggaaaataaaaaaggtaatagaacttgtagtttatttaaaccccatgtcatgaggaggtactagttccaagcaacaaactccttaatttgctctaatagataggtatggtttaatctttccattgtgtcttttcatttaattttcctgaagcttgcaggatagattgaaatgttataggtttgtttggagtaaccaaacagtatgcaaattaagaaaaagccagagaacctagaaaacatccagtggattacagaatttcttccccatattcactcctcacttttacaattttcccacaatcctctacttcagtgggatgctgtgtctagtgattaaacaaaaatatagagctgtgcaatttgattttggcttccacaacgaatatctga

SEQ ID NO: 345440 - DNA, 866 bp, Homo sapiens
tgctcatttaatttatgagcaatgactgctcggctcattgggaatccacatccccaagttagactggggatatgctctctgtactgtctccttctatggaattccaccccacccagagagagatgacttcacagtttgttcatatgagcatcatcccatgtcgtccccaacccagggctggtaggtgctacagcttgtgcttcatgctgctcctgtggcccctattcctacccagctcagagctttgcagggtctactgcagacaatcagaagtcagtttctaacaaatagcaacagccacaaatctcttcctccttcctctctgacattaccctgtgcaacttttctcaaagtctgttgcaccactcagcaaagcaagttgcaccagctatatcagaatcacctggggcagcctattaaaaatgcagactgttgagaccatcctggctaacacggtgaaaccctgtctctactaaaaatacaaaaaattagccggccgtggtggcgggcagctactcgggaggctgaggcaggagaatgacctgaacctgggaggcagagcttgcagtgagctgagattgtgccactgcactccagcctgggtgacagagcaagactccgtctcaaaaaaaaaaaaaaagaaaaatgcagactggctggcgcggtggctcatgcttgtaatcccagcactttgggaggctgaggcgggcagatcaactgagatcgggggttcgagaccagcctgatcaacatggagaaacctggtctctactaaaaatacataattagctgggcgtagtggcgcatacctgtaatcccagctacttgggtggccaaggcttgaacccaggaggcggaggttgcgg

SEQ ID NO: 345441 - DNA, 354 bp, Homo sapiens
cttgtggatgaccttgacgcctatttcgttagcgaagatgagacaatcacggcagtctgcaaggaacccacgcggcccaagttcaagatgccagagatgaatatcaaagcccccaagatccccatgcctgactttgatttgcatctgaaaggaacccacggccgtgggttccttgcagaggaagcatgcactcaggagtcacagagcacgggcagtatcgtgcgcttctcctttctggaaatcacgtgcacatactcacatacgcgtaacgaacacacatacagacaaggcaagccacaaactgttatacaggtaggaaggaggaagatctgacaaagcagcaggtgtcatact

SEQ ID NO: 345442 - DNA, 2336 bp, Homo sapiens
tggatgtgaacttgcccaaggctgacgttgatgtctcaggacccaaggtggatgttgaagtcccagatgtgagccttgaaggtccagaagggaagctgaagggccccaagtttaagatgcctgagatgcacttcaagacccccaagatctccatgcctgatgttgatttcaatttaaagggacccaaaatcaaaggagatgttgatgtttctgccccaaagctggagggagagttaaaaggtccagaattggatgtcaaaggtcccaaattagatgctgacatgccagaagtagctgtggaaggcccaaatggcaagtggaaaactcctaagttcaagatgccagatatgcactttaaagctcccaaaatctctatgccagacctcgatctacacttgaagagccccaaggcaaaaggagaggtggatgtagatgttcccaaattggaaggggaccttaaagggccacatgtggatgtcagtgggccagacattgacattgagggaccagagggcaaattgaaaggccctaagttcaagatgcctgatatgcatttcaaagcccccaatatttctatgcctgatgttgatctaaatctcaaaggacccaaaatcaagggggatgtggatgtgtctgtgcctgaggtagaaggtaaacttgaagtaccagatatgaacatcaggggccccaaagttgatgtaaatgcccccgatgtccaagctccagactggcacctgaagatgcccaagatgaaaatgcccaagttcagcatgcctggcttcaaagcagagggccctgaagtagacgtcaacttgcctaaggctgacgttgacatctcaggacccaaggtggacattgaaggccctgatgttaatattgaaggaccagagggaaagttgaaagggcctaagttaaagatgccagagatgaacatcaaagcccccaagatctccatgcctgactttgatttgcatctgaaaggtcccaaggtgaagggcgatgtggatgtttctctgcccaaagtggaaggtgacctcaagggccccgaagttgacatcaaggggcccaaagtggatattaatgccccagatgtgggtgttcaaggcccagactggcacctgaagatgcccaaggtgaaaatgccaaagttcagtatgcctggcttcaaaggagagggcccagatggggatgtgaagctgcccaaggctgacattgatgtctcaggacccaaagtggacattgaaggccctgatgttaacattgaaggaccagagggaaagttgaaagggcctaagttcaagatgccagagatgaatatcaaagcccccaagatctccatgcctgatattgacttaaacctgaaaggacccaaagtgaagggtgatgtggatgtttcccttcctaaagtggaaggtgacctcaagggcccagaagttgacatcaagggcccaaaagtggacattgacgcacctgatgttgatgttcatggcccagactggcacctaaagatgcccaagataaaaatgcccaagatcagcatgcctggcttcaaaggagaaggtccagatgtggacgtgaacctgcccaaggctgacattgatgtctcaggaccgaaagtggatgttgaatgtcccgatgtgaatatcgaaggacctgaaggaaagtggaaaagtccaaagtttaagatgccagagatgcattttaagactccaaagatatccatgccagatattgacctgaatctcacaggtccaaaaataaaaggagatgtggatgttacaggccctaaggtagagggagatctgaaaggtcctgaagttgacctcaaaggccccaaagtggacattgatgtcccagatgttaatgttcagggtccagactggcacctgaagatgcccaagatgaaaatgcccaagttcagcatgcctggcttcaaagcagagggccctgaagtggatgtgaacctgcccaaggctgacgttgatgtctcaggccccaaagtggacgttgaaggccctgatgttaacattgaaggaccagagggaaagttgaaagggcccaagttcaagatgccagagatgaatatcaaagcccccaagatccccatgcctgactttgatttgcatctgaaaggaacccacggccgtgggttccttgcagaggaagcatgcactcaggagtcacagagcacgggcagtatcgtgcgcttctcctttctggaaatcacgtgcacatactcacatacgcgtaacgaacacacatacagacaaggcaagccacaaactgttatacaggtaggaaggaggaagatctgacaaagcagcaggtgtcatact

SEQ ID NO: 345443 - DNA, 1568 bp, Homo sapiens
tggatgtgaacttgcccaaggctgacgttgatgtctcaggacccaaggtggatgttgaagtcccagatgtgagccttgaaggtccagaagggaagctgaagggccccaagtttaagatgcctgagatgcacttcaagacccccaagatctccatgcctgatgttgatttcaatttaaagggacccaaaatcaaaggagatgttgatgtttctgccccaaagctggagggagagttaaaaggtccagaattggatgtcaaaggtcccaaattagatgctgacatgccagaagtagctgtggaaggcccaaatggcaagtggaaaactcctaagttcaagatgccagatatgcactttaaagctcccaaaatctctatgccagacctcgatctacacttgaagagccccaaggcaaaaggagaggtggatgtagatgttcccaaattggaaggggaccttaaagggccacatgtggatgtcagtgggccagacattgacattgagggaccagagggcaaattgaaaggccctaagttcaagatgcctgatatgcatttcaaagcccccaatatttctatgcctgatgttgatctaaatctcaaaggacccaaaatcaagggggatgtggatgtgtctgtgcctgaggtagaaggtaaacttgaagtaccagatatgaacatcaggggccccaaagttgatgtaaatgcccccgatgtccaagctccagactggcacctgaagatgcccaagatgaaaatgcccaagttcagcatgcctggcttcaaagcagagggccctgaagtagacgtcaacttgcctaaggctgacattgatgtctcaggaccgaaagtggatgttgaatgtcccgatgtgaatatcgaaggacctgaaggaaagtggaaaagtccaaagtttaagatgccagagatgcattttaagactccaaagatatccatgccagatattgacctgaatctcacaggtccaaaaataaaaggagatgtggatgttacaggccctaaggtagagggagatctgaaaggtcctgaagttgacctcaaaggccccaaagtggacattgatgtcccagatgttaatgttcagggtccagactggcacctgaagatgcccaagatgaaaatgcccaagttcagcatgcctggcttcaaagcagagggccctgaagtggatgtgaacctgcccaaggctgacgttgatgtctcaggccccaaagtggacgttgaaggccctgatgttaacattgaaggaccagagggaaagttgaaagggcccaagttcaagatgccagagatgaatatcaaagcccccaagatccccatgcctgactttgatttgcatctgaaaggaacccacggccgtgggttccttgcagaggaagcatgcactcaggagtcacagagcacgggcagtatcgtgcgcttctcctttctggaaatcacgtgcacatactcacatacgcgtaacgaacacacatacagacaaggcaagccacaaactgttatacaggtaggaaggaggaagatctgacaaagcagcaggtgtcatact

SEQ ID NO: 345444 - DNA, 428 bp, Homo sapiens
atgttgagctggagtgtcctgatgcaaagttgaaaggccctaaatttaagatgccagacatgcacttcaaggcccccaagatctccatgcctgatgtggacttacacttgaaaggccccaaagtcaaaggggatgtggatgtgtcggtgccaaaattggagggagatttaacaggtcccagtgtgggtgtggaggtgcctgatgttgagctggagtgtcctgatgcaaagttgaaagggcccaagtttaagatgcctgagatgcacttcaagacccccaagtcaaaggggatgtggatgtgtctttgccaaaattggagggagatttaacaggccccagtgtggatgtggaggtgcctgatgttgagctggagtgtcctgatgcaaagttgaaagggcccaagtttaagatgcctgagatgcacttca

SEQ ID NO: 345445 - DNA, 431 bp, Homo sapiens
atgttgagctggagtgtcctgatgcaaagttgaaaggccctaaatttaagatgccagacatgcacttcaaggcccccaagatctccatgcctgatgtggacttacacttgaaaggccccaaagtcaaaggggatgtggatgtgtcggtgccaaaattggagggagatttaacaggtcccagtgtgggtgtggaggtgcctgatgaatagcgattaaaccccacgatcactttattaatattcattcattcatttgttacatgctggggagaataaaatgaattctcctcattataaatagaatgagattgaagtccaaaggaaaataaatagtatacaggttttcattcatttatttattcattcagtccacatttcttcaattcttactaaagccaggccctatcacgggtgccgataaatagcgagggg

SEQ ID NO: 345446 - DNA, 1732 bp, Homo sapiens
tggatgtgaacttgcccaaggctgacgttgatgtctcaggacccaaggtggatgttgaagtcccagatgtgagccttgaaggtccagaagggaagctgaagggccccaagtttaagatgcctgagatgcacttcaagacccccaagatctccatgcctgatgttgatttcaatttaaagggacccaaaatcaaaggagatgttgatgtttctgccccaaagctggagggagagttaaaaggtccagaattggatgtcaaaggtcccaaattagatgctgacatgccagaagtagctgtggaaggcccaaatggcaagtggaaaactcctaagttcaagatgccagatatgcactttaaagctcccaaaatctctatgccagacctcgatctacacttgaagagccccaaggcaaaaggagaggtggatgtagatgttcccaaattggaaggggaccttaaagggccacatgtggatgtcagtgggccagacattgacattgagggaccagagggcaaattgaaaggccctaagttcaagatgcctgatatgcatttcaaagcccccaatatttctatgcctgatgttgatctaaatctcaaaggacccaaaatcaagggggatgtggatgtgtctgtgcctgaggtagaaggtaaacttgaagtaccagatatgaacatcaggggccccaaagttgatgtaaatgcccccgatgtccaagctccagactggcacctgaagatgcccaagatgaaaatgcccaagttcagcatgcctggcttcaaagcagagggccctgaagtagacgtcaacttgcctaaggctgacgttgacatctcaggacccaaggtggacattgaaggccctgatgttaatattgaaggaccagagggaaagttgaaagggcctaagttaaagatgccagagatgaacatcaaagcccccaagatctccatgcctgactttgatttgcatctgaaaggtcccaaggtgaagggcgatgtggatgtttctctgcccaaagtggaaggtgacctcaagggccccgaagttgacatcaaggggcccaaagtggatattaatgccccagatgtgggtgttcaaggcccagactggcacctgaagatgcccaaggtgaaaatgccaaagttcagtatgcctggcttcaaaggagagggcccagatggggatgtgaagctgcccaaggctgacattgatgtctcaggacccaaagtggacattgaaggccctgatgttaacattgaaggaccagagggaaagttgaaagggcctaagttcaagatgccagagatgaatatcaaagcccccaagatctccatgcctgatattgacttaaacctgaaaggacccaaagtgaagggtgatgtggatgtttcccttcctaaagtggaaggtgacctcaagggcccagaagttgacatcaagggcccaaaagtggacattgacgcacctgatgttgatgttcatggcccagactggcacctaaagatgcccaagataaaaatgcccaagatcagcatgcctggcttcaaaggagaaggtccagatgtggacgtgaacctgcccaaggctgacattgatgtctcaggaccgaaagtggatgttgaatgtcccgatgtgaatatcgaaggacctgagctgctggaacctattccctatgaattcatggcataataggtgttaaaaaaaaaaataaaggacctctgggctac

SEQ ID NO: 345447 - DNA, 855 bp, Homo sapiens
atgttgagctggagtgtcctgatgcaaagttgaaaggccctaaatttaagatgccagacatgcacttcaaggcccccaagatctccatgcctgatgtggacttacacttgaaaggccccaaagtcaaaggggatgtggatgtgtcggtgccaaaattggagggagatttaacaggtcccagtgtgggtgtggaggtgcctgatgttgagctggagtgtcctgatgcaaagttgaaagggcccaagtttaagatgcctgagatgcacttcaagacccccaagatctccatgcctgatgtggacttacacctgaaaggccccaaagtcaaaggggatatggatgtgtctgtgcccaaggtagaaggtgaaatgaaagtgccagatgttgacatcaaaggacccaaaatggacattgatgccccagatgtggatgttcatggcccagactggcacctgaagatgcccaagatgaaaatgcccaagttcagcatgcctggcttcaaagcagagggcccagaagtggatgtgaacttgcccaaggctgatgttgttgtctcaggacccaaggtggatgttgaagtcccagatgtgagccttgaaggtccagaagggaagctgaagggccccaagcttaagatgcctgagatgcacttcaaggcccccaagatctccatgcctgatgtggacttacacttgaaaggccccaaagtcaaaggggatgtggatgtgtctttgccaaaattggagggagatttaacaggccccagtgtggatgtggaggtgcctgatgttgagctggagtgtcctgatgcaaagttgaaagggcccaagtttaagatgcctgagatgcacttca

SEQ ID NO: 345448 - DNA, 621 bp, Homo sapiens
caggtagttgcgtttcttctcaggtagttgcgtttcttcttgcgtttcttctcaggtagttgcgtttcttctcaggtagagggagatctgaaaggtcctgaagttgacctcaaaggccccaaagtggacattgatgtcccagatgttaatgttcagggtccagactggcacctgaagatgcccaagatgaaaatgcccaagttcagcatgcctggcttcaaagcagagggccctgaagtggatgtgaacctgcccaaggctgacgttgatgtctcaggccccaaagtggacgttgaaggccctgatgttaacattgaaggaccagagggaaagttgaaagggcccaagttcaagatgccagagatgaatatcaaagcccccaagatccccatgcctgactttgatttgcatctgaaaggaacccacggccgtgggttccttgcagaggaagcatgcactcaggagtcacagagcacgggcagtatcgtgcgcttctcctttctggaaatcacgtgcacatactcacatacgcgtaacgaacacacatacagacaaggcaagccacaaactgttatacaggtaggaaggaggaagatctgacaaagcagcaggtgtcatact

SEQ ID NO: 345449 - DNA, 470 bp, Homo sapiens
gttcctgcgcctcgggaggaggctctgcgcgggactgcaggttctgccccgcatcggagtgatcgctgagcctgacgctctcgaaggctgggcctggggcccgcaatctactccggaggctttcccactgggcagggtcgctagcaggaggaggaagcattcccatgtgaaagatgagctccctataaaagcaacgctcttatcatcgagaacagaaagttgaagccaagagagagctccacaagctgaccttgttaaactaacccttatcttcttagtcgcttctttacccaattaactaccctagccgaagcccctttgccttattacattttgcaacagtgttcgttgtccaattcagtatacaagtgagtgactctggatgctttttggggtcttcgtttccttatgagggcttctgtgccatgtaaaacttgtattaaataaatttgtatgcttttctcctgtta

SEQ ID NO: 345450 - DNA, 461 bp, Homo sapiens
gagtgccggggccacaggaagaatttgtggcgacatcatcccttccccaggtgccacccgggtgcagtgaggacctggagcccctgccccaggctgtgaggagacttgaccagagctgcctgaatgctccacggagcagaggaggaagcattcccatgtgaaagatgagctccctataaaagcaacgctcttatcatcgagaacagaaagttgaagccaagagagagctccacaagctgaccttgttaaactaacccttatcttcttagtcgcttctttacccaattaactaccctagccgaagcccctttgccttattacattttgcaacagtgttcgttgtccaattcagtatacaagtgagtgactctggatgctttttggggtcttcgtttccttatgagggcttctgtgccatgtaaaacttgtattaaataaatttgtatgcttttctcctgtta

SEQ ID NO: 345451 - DNA, 942 bp, Homo sapiens
gttcctgcgcctcgggaggaggctctgcgcgggactgcaggttctgccccgcatcggagtgatcgctgagcctgacgctctcgaaggctgggcctggggcccgcaatctactccggaggctttcccactgggcagggtcgctagcaggaggaggaagcattcccatgtgaaagatgagctccctataaaagcaacgctcttatcatcgagaacagaaagttgaagccaagagagagctccacaagctgaccttgttaaactaacccttatcttcttagtcgcttctttacccaattaactaccctagccgaagcccctttgccttattacattttgcaacagtgttcgttgtccaattcagtatacaagtgagtgactctggatgctttttggggtcttcgtttccttatgagggcttctgtgccatgtaaaacttgtattaaataaatttgtatgcttttctcctgttaatctgtctatatcgattgaactttagggtccagtcagaacccaaagaggatggaggtggagttttggctcctctacagctatctgaataatcaaaattcaagatattccatgttctttctgagtttctttgaaattaaaaatgcagacaaccactcaactaatacgtcagcgagatacgttttctgtccttattgccttactgatgaaattgcctttattcataaaaaataaatgtgggagtcttgtttatttatttctaatgacattaacttgacattaaccttggtgctcttgggaaccataaatgggccctgtactacttgttacagagtataaattcccagaactacaagtacatcatattcctcaagttactgaagaatttcatgatccatgtgtcaggcctctgagcccaagctaagtcatcatatcccctgtgacctgcacgtatacatccagatggccggttcc

SEQ ID NO: 345452 - DNA, 192 bp, Homo sapiens
tgggagatttgagcaaggtttaagttgaaataattaggcatcagcaaaccataatcacaacagcagggacgtggctgctgctccaaatctgcctaacgaaggcagcacaatctttaatacctgtgcagctttgtaaatggagacaggatactctcttttgaaagctgagattccctgtccagtctgggggag

SEQ ID NO: 345453 - DNA, 526 bp, Homo sapiens
ctgaatgatgacttacatgttccatacaacataaatgaagagacaatattagttagacatgtccaagcaattctttaacattcaaatgataagcaaagaattttacaaatatgtaggatggagaaaaataaataacctaaaaaagaacaaaaattgggctggcctcagtcttctctatggcaataaatgatagcctacaattaagcaagttgacaacattttaggaaaaaatggtcttttgcatttgtgaagacagcaaaaatattatcagctataagaattcagaaagcatataactacatacccatcctccaaattttactcaaattcatgatgggacaactggatttccacatgtaaaagaatgaagttggacccctacaccatctacaaaaattaattcaaaatgaaagaatgacttaaatatatgtactaacaccacagaactcttagcagaaaacataggggcaaagcttcatgacactggatttggcaatgatttcttggatatgacatcaaaagcaca

SEQ ID NO: 345454 - DNA, 709 bp, Homo sapiens
tttgctttttattaaatgtacatagcattgtcttctaactcacgttcttgaccagcctttaaaacacacacactgctttacacgttttatctccttgtcgccttagtctatatatacactgttgacttcattaaaattatataaagtgccattctaggttcctggatgaccatctttttttcccttccagcttctacttatacgattattattgccattatttctttccaggaatttctatatgattttgataagcatcatcatatttagtgttatcagcaaagacacaagctcaaaagtgacatcttttccatgaatccaggaaagaagaaaaatccactcagttcagataaatcctagcaattcccaaagggaaaggcattggatatgtgtttgatgagaaagaaaatgaaaaaggggtggggtggtagtactcttctacctgcttctcaaaaccagaacattgctcggtcagattaaacccagtgaaaaacacttacaataaccagtatacagcatgttttcccacagcttatttggaaaaaaagacaggtaacagtcaaagttagagaagctgtaagcaatggacaggcttgatattaagtgtgcaggatctgggctaaatgccttaaaatgtgcaattcaactttccacttctgaatgtggaggcttctcccaagttagtggctgggtggaggggaaatacttg

SEQ ID NO: 345455 - DNA, 361 bp, Homo sapiens
gtttcattgttgctactgtgcactgtttcactgttgcactgaggttttagtacagatgaggttcacgttgcccaggctggtcttgaactcctgggctcaagtgatcctgggcaatcccaagcagtgctgggactgcaagcatgagccactgtgcccagcctaaaaacaaatccctgttattccctgtctcagtaaatggaatcaccatgtaaccagttttacacattagagaccgggtagtcagctgggtgtggtggctcatgcctgtaatcccagcactttgcaaggccgaggtgggtggatcacctgaggtaaggagttcgagagcagcctggccaacatgacgaaaccctgtctctaa

SEQ ID NO: 345456 - DNA, 740 bp, Homo sapiens
  misc_feature (113)..(113): n is a, c, g, or t
  misc_feature (684)..(684): n is a, c, g, or t
aatacagcgcattcaacttgcaaacacccttccactcccacaaagagcaagctgtcactggccaatcaaaacaatgaaccataatgaaacagtttttcttgctccacccactnggtgaccaaatttgaaaaaaaaaaaaaaccgcgccaactcatgttgttttcaatcaggtccgccaagtttgtatttaaggaactgtttcagttcataccttccactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaaaaaaaacccaaaggcccttttcagggccgctcacaaagtcgtttaaagagctgaaatgcgttgcgagaatgagtttggatgacagaaataaccgtgacancctgcataagaatgaattgtgtttgccatgaccggccacactgtgacaaaatttca

SEQ ID NO: 345457 - DNA, 744 bp, Homo sapiens
  misc_feature (113)..(113): n is a, c, g, or t
  misc_feature (636)..(636): n is a, c, g, or t
  misc_feature (730)..(730): n is a, c, g, or t
  misc_feature (744)..(744): n is a, c, g, or t
aatacagcgcattcaacttgcaaacacccttccactcccacaaagagcaagctgtcactggccaatcaaaacaatgaaccataatgaaacagtttttcttgctccacccactnggtgaccaaatttgaaaaaaaaaaaaaaccgcgccaactcatgttgttttcaatcaggtccgccaagtttgtatttaaggaactgtttcagttcataccttccactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaaaaaaaaaaagcggccgctcgattcgaatcagttatcgataccgtcgactcanggggggcccggtaccattcgcctaaagtgatcgtattaaattcatgggcgtcgtttgtcgtgatgggcctggcgttaccttatcgcttgcacanatccccctttgccn

SEQ ID NO: 345458 - DNA, 706 bp, Homo sapiens
  misc_feature (113)..(113): n is a, c, g, or t
aatacagcgcattcaacttgcaaacacccttccactcccacaaagagcaagctgtcactggccaatcaaaacaatgaaccataatgaaacagtttttcttgctccacccactnggtgaccaaatttgaaaaaaaaaaaaaaccgcgccaactcatgttgttttcaatcaggtccgccaagtttgtatttaaggaactgtttcagttcataccttccactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaataaaatttataataataccatgtcggccgtttctgcccaaccgactttagactccagcaagcttaatcattctggcccaatttgagcctaacttgcccatattcccctatagtgaagtcgaa

SEQ ID NO: 345459 - DNA, 877 bp, Homo sapiens
  misc_feature (1)..(1): n is a, c, g, or t
  misc_feature (33)..(33): n is a, c, g, or t
  misc_feature (73)..(74): n is a, c, g, or t
  misc_feature (88)..(88): n is a, c, g, or t
  misc_feature (90)..(90): n is a, c, g, or t
  misc_feature (97)..(97): n is a, c, g, or t
  misc_feature (123)..(123): n is a, c, g, or t
  misc_feature (542)..(542): n is a, c, g, or t
nccaggccaaattggtaacccccggccccatcnccaccttaaacgacgcccatgattgtaatacgactcaccnnaggccaaggttacngnccccccntcgagttcgacgtatcgttagcttgntatcgaattcgcggccgcgcgacggctgcgagaagacgacagaaggggactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaatanttataaaaaaaacatgtggccgcccttggtccaacaagtcttttaatttcttcaagctttttcatttcggcgccaaattaagcgatcttttggccaaatacccccttataaggggggggttttaacaaaaaaaggggcccgcgttttaaaaacagttgatttgtgaaaaaccctgggggtcccacactaaaagacctttttgaacaaaaacccttttttgcgggcggtgggattaacaaaaaagcccccacccaaagggtcttttcaaaaaaatgggccccctttaaggggcaatgaaaaatttgccggcctaaatattttttaccccgcgattt

SEQ ID NO: 345460 - DNA, 695 bp, Homo sapiens
  misc_feature (1)..(1): n is a, c, g, or t
  misc_feature (33)..(33): n is a, c, g, or t
  misc_feature (73)..(74): n is a, c, g, or t
  misc_feature (88)..(88): n is a, c, g, or t
  misc_feature (90)..(90): n is a, c, g, or t
  misc_feature (97)..(97): n is a, c, g, or t
  misc_feature (123)..(123): n is a, c, g, or t
  misc_feature (639)..(639): n is a, c, g, or t
nccaggccaaattggtaacccccggccccatcnccaccttaaacgacgcccatgattgtaatacgactcaccnnaggccaaggttacngnccccccntcgagttcgacgtatcgttagcttgntatcgaattcgcggccgcgcgacggctgcgagaagacgacagaaggggactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaaaaaaaacccaaaggcccttttcagggccgctcacaaagtcgtttaaagagctgaaatgcgttgcgagaatgagtttggatgacagaaataaccgtgacancctgcataagaatgaattgtgtttgccatgaccggccacactgtgacaaaatttca

SEQ ID NO: 345461 - DNA, 784 bp, Homo sapiens
  misc_feature (26)..(26): n is a, c, g, or t
  misc_feature (39)..(39): n is a, c, g, or t
  misc_feature (449)..(449): n is a, c, g, or t
cagaaacttagtggaatccccccggncttgccaggaacncggccgcgcgacacggctgcgagaagacgacagaaggggactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaatanttataaaaaaaacatgtggccgcccttggtccaacaagtcttttaatttcttcaagctttttcatttcggcgccaaattaagcgatcttttggccaaatacccccttataaggggggggttttaacaaaaaaaggggcccgcgttttaaaaacagttgatttgtgaaaaaccctgggggtcccacactaaaagacctttttgaacaaaaacccttttttgcgggcggtgggattaacaaaaaagcccccacccaaagggtcttttcaaaaaaatgggccccctttaaggggcaatgaaaaatttgccggcctaaatattttttaccccgcgattt

SEQ ID NO: 345462 - DNA, 668 bp, Homo sapiens
  misc_feature (113)..(113): n is a, c, g, or t
  misc_feature (566)..(566): n is a, c, g, or t
aatacagcgcattcaacttgcaaacacccttccactcccacaaagagcaagctgtcactggccaatcaaaacaatgaaccataatgaaacagtttttcttgctccacccactnggtgaccaaatttgaaaaaaaaaaaaaaccgcgccaactcatgttgttttcaatcaggtccgccaagtttgtatttaaggaactgtttcagttcataccttccactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcgggcttgggaaaaaaaattttcccccctntttttaaaaaaaaaagggggggaaaaaaaaaaattttttaaaaccccccgggcgccgtcttatgagaacttaaaaacaataaaaaaggctaccgatcttcta

SEQ ID NO: 345463 - DNA, 438 bp, Homo sapiens
  misc_feature (7)..(7): n is a, c, g, or t
  misc_feature (9)..(10): n is a, c, g, or t
  misc_feature (37)..(38): n is a, c, g, or t
gggcacngnnaaaaaaaaaaagtggtaaaggaacccnnacaacagccacccctacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaataaaatttataataataccatgtcggccgtttctgcccaaccgactttagactccagcaagcttaatcattctggcccaatttgagcctaacttgcccatattcccctatagtgaagtcgaa

SEQ ID NO: 345464 - DNA, 654 bp, Homo sapiens
  misc_feature (1)..(1): n is a, c, g, or t
  misc_feature (33)..(33): n is a, c, g, or t
  misc_feature (73)..(74): n is a, c, g, or t
  misc_feature (88)..(88): n is a, c, g, or t
  misc_feature (90)..(90): n is a, c, g, or t
  misc_feature (97)..(97): n is a, c, g, or t
  misc_feature (123)..(123): n is a, c, g, or t
  misc_feature (588)..(588): n is a, c, g, or t
  misc_feature (652)..(652): n is a, c, g, or t
nccaggccaaattggtaacccccggccccatcnccaccttaaacgacgcccatgattgtaatacgactcaccnnaggccaaggttacngnccccccntcgagttcgacgtatcgttagcttgntatcgaattcgcggccgcgcgacggctgcgagaagacgacagaaggggactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaaaagcggccgtcgaatgtcgacgcggccgcgaattcgtatcaactatcgnacctcgactcaggggggccgtaccaattgccctatatgatcgtattacaatcatggcgcgtttngt

SEQ ID NO: 345465 - DNA, 830 bp, Homo sapiens
  misc_feature (1)..(1): n is a, c, g, or t
  misc_feature (33)..(33): n is a, c, g, or t
  misc_feature (73)..(74): n is a, c, g, or t
  misc_feature (88)..(88): n is a, c, g, or t
  misc_feature (90)..(90): n is a, c, g, or t
  misc_feature (97)..(97): n is a, c, g, or t
  misc_feature (123)..(123): n is a, c, g, or t
nccaggccaaattggtaacccccggccccatcnccaccttaaacgacgcccatgattgtaatacgactcaccnnaggccaaggttacngnccccccntcgagttcgacgtatcgttagcttgntatcgaattcgcggccgcgcgacggctgcgagaagacgacagaaggggactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaaatcttgtcggccgtttcggaccagactattgtatactccagcatgttgatgcatgcggccgtattacgtgcttagtcgcacaaatccctctaatgggaggtctacaacaaactagtgcccgttgttcaacaacgtgactgctgaaacaacccgtgtttcacacatattaaacgtcgttgcagaacattcttttttccacatggtgcagtaatcgcgaaggagcccaccacagagcgttcttcaccacagtgccacactcatgagtggatgtggttggcgccgattattttt

SEQ ID NO: 345466 - DNA, 771 bp, Homo sapiens
  misc_feature (436)..(436): n is a, c, g, or t
cgaaccggccgcgcgacacgccgagaagagacgaaggtacggctgcgagaagacgacagaaggggactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaatanttataaaaaaaacatgtggccgcccttggtccaacaagtcttttaatttcttcaagctttttcatttcggcgccaaattaagcgatcttttggccaaatacccccttataaggggggggttttaacaaaaaaaggggcccgcgttttaaaaacagttgatttgtgaaaaaccctgggggtcccacactaaaagacctttttgaacaaaaacccttttttgcgggcggtgggattaacaaaaaagcccccacccaaagggtcttttcaaaaaaatgggccccctttaaggggcaatgaaaaatttgccggcctaaatattttttaccccgcgattt

SEQ ID NO: 345467 - DNA, 127 bp, Homo sapiens
ggagatgctgaaaaggcagctgataaaattcgacatcctttcctgataaaatctagtaagccaggaagacaatgctacttccttaaactcgtgataaatatttatctgaaatcaacagtcagcatca

SEQ ID NO: 345468 - DNA, 363 bp, Homo sapiens
atcccttgttgatggacattgacgttagtgcttggttttctcttctgtaattggagtggtgaatgtccttgtagctaaatctctgcacacatccatgattattttcaaaagataattcctagaagtagaattcctattttgttgccaaacgccttccagaatggatgttcaggtttacatttcaactagcatttataactgttcatttccccacatcctaatcaaacaaggaaggcattttatttaccctttcctagttgaatagttgtaggatgatgtctcattgtttatgatttttaaaaaatgttttgaaacaatttcagtcctacaagaaattacatatgcagtacaggtctcactcca

SEQ ID NO: 345469 - DNA, 142 bp, Homo sapiens
tgtatttttagtagagacggggtttcaccgtgttggccaggatggtctcgatctcttgacctcgtgatccaccaggcgtgcgccaccgcgccaggcctatttatactttttaaataactcgtcacacttttatcatattctc

SEQ ID NO: 345470 - DNA, 1059 bp, Homo sapiens
gatgtcctcatttatggaacccctgctatccacccgcacaccccgcttggggcctgctttacccaaagcctttcccgtcgcagtcagtggcattactggcctccagtggctcaggcgagagcactcggtgatctctgactcctctctttctctcgtaggccgtaatggtcctcaggaaatcattccagctctaccttgagagcacacacagaacctgacgcttcttaccacccccaccctgtagcatcttagcccggggcctgtcatctctttcccgggtcacacacagcagtggtgttcatgaagctcctcctgccctcacagtggctgttctcacacagaagctgggtcagacccgcagaggcccctgtctacagggcctcacagtggcctgtgaagaccctgcactttctgctcgctgtaacctctttgccggctgtctccctctgcccactttacccggccacacctgcccccagtgctgtctgtgaccacccaggcatgcgtccaccttgagccctggcaccggctgccctctctgctcaggagacatctaccccagataacttgttcggtcctttccttctcatctttcaagactttgcacaaatcttcccttctccttaaagttttatcctgaccactgaattcaacacttcatccctttctcccttccttactgagctccgctttttgatttttttctggagcatttcactttgtaacttaatgtgtaatttacctatttcttatgttcatgtctaattgtctgtttccactagaatgcaagcatcacaggggcagggtgtttgtgtattgatgtatttcaagatctagaacagtgtgctcagcacatagtagaccatatgttttgatcatatgaatgaatgcctgcatccaagaatgttcttacagtcttgggtggtcttgggggtcagcctttggtggggaaccaacttgggagaaggaatagctctgacggctgctgggtattggctacctgaataataagggctcttggagtcatttagcacaagggtttttcacctgcatttagag

SEQ ID NO: 345471 - DNA, 385 bp, Homo sapiens
tcccgggagcagggacagtgtgtgggcaggcagggctggcgacaagagctgagggaagaccagaagggctgaatggcatgtttgagggggaggccactgtgctgtgcttcaggctggcagggcagccacacctgggaatctgggtgccaaggtgagcagggctgggaaagcccctgtaggactttaatggagtggttggaaggagggggtcaaactttcaatgtgcctcttccagcctttcaggtcaggcaggtctggtgttgggttgccctgccctgtccacatcctacagagagagcttccgaatgggcagcccctttccatgcctgtacccctgacatccagcataggacttcttttccttttttgagacaaggtctgactc

SEQ ID NO: 345472 - DNA, 410 bp, Homo sapiens
catcccttacgccatactttggtaaatactgttcatggtcttagaaatgccaagcaagcagacagcaggaaactagtgatctagaatcagcaagaaacctctaagataaagaaactgaagcacagttaagtaatccatccaagatcacacagctaatgggaggagtgaaccccatacactcaagtaccaataccacactcttaatcactaagccaggatcaatctgatcatccacaagtgttctcctggagggactcagaaatgagttgtgcagagcgatgcagaatcattccttggagcacttccagcagaaataagacacagaaagaaggttctacttcactgatcctcaaacattgcaatatgtgtacatgtcaatcagcaataaacttaaatataagatcgtcaac

SEQ ID NO: 345473 - DNA, 669 bp, Homo sapiens
ctcctgcctcagagcccttcccaggactgtatcattggggcagataagaggatttgctgcggggctaaggcagtgtccacggggccttgaacagtgcatccccttggaggcactcagccacccagcagcttagcttgttgcattggcgagaagattctgtgggaaggaatagggtgtaaacgactctcactttccacactgtctgactcccgtaagctgttatccttgaaaataaagtgcagtgtttggcaagatagaaagggctgtggtggcagtttgcctagagagccctagtgttagcttagtgtcctctcagctgggatccagttcccttcaaagcaccttctccctacattcctgtgggaatgccctgtaggaagagggaattttctgtgagaagaaggtggattccctgaggaaatctgtgagacagaacatgtggctaatttttttttcatatgttactttaatcttcataaacaaggcatgtgttccttgcagaagcagtatgtggagacagccaagcttgcagcagttgcagtagtgtggaaatctttttgcctgtcttataatttcgtttgtttttttacttccccagattagtctgctgaactcaattcatgagaacttctcacagtaagtactgtcagtcctccttcccactaatac

SEQ ID NO: 345474 - DNA, 439 bp, Homo sapiens
gctcaaggatgtgaagtaaggctttaaagctcctgcacggctactcagcactaggtcccattggatcttaacatcttggatacccagctggttgcttttcctatagaacagcatgtgttgatagcttcttatcacctagtcagttcaactatgctgatttgagttcatgagttgggccatgtctgaactggccttcacttcagtgggatgttgtccttagcaactcttgtcttttcactttcttccccagtggctggtctgaggtttcagtgcttaagaggatttgaaatgagaactctcgtcttaagcactattccttatgaccccctttttcttactggctgtgtagggatctatgttggagccatctgcagggtttgtagccttttcccatggagaatatattacaatttgttcgaaaattgagacttcgtcaggc

SEQ ID NO: 345475 - DNA, 2874 bp, Homo sapiens
ggcaggcggcggcggcggcggcggcggcggcagagggagtttccgctttgcactccaccccggtagcagctccgcggcagggacagcttcctccggacgcttggcgggcttcgctctcgccttacgacagcccggtcggatcatggggttgcccagggggccggagggccagggtctcccggaggtggaaacaagagaagatgaagaacaaaatgtcaagttgactgaaattctggagctcttggttgcagctgggtatttcagggcaagaattaaaggcttatcaccctttgacaaggtagtaggaggaatgacttggtgtatcaccacttgcaactttgatgtagatgttgatttgctctttcaagaaaactctacgataggtcaaaaaatagctctgtcagaaaaaattgtctcggtcctgccaaggatgaaatgcccacaccagctggagccccaccagatccaggggatggattttattcacatatttcctgttgttcagtggctggtgaaacgagctatagaaacaaaagaagagatgggtgactatatccgctcctactctgtatcccagttccagaagacttacagtctccctgaggatgatgacttcataaagagaaaagaaaaggccatcaagacagttgtggacctctcagaagtgtacaagccccgtcggaaatacaaacgccaccagggagcagaggagctacttgatgaagaatctcgaatccatgctacacttttggaatatggcaggagatatggatttagccgccagagcaaaatggagaaggctgaggacaagaaaacggcacttccagcagggctgtcagctacagaaaaagctgatgcccacgaggaagatgagcttcgagcagctgaagagcagcgtattcagtcgctgatgaccaagatgaccgctatggcaaatgaggagagccgtctcaccgcaagctccgtgggccagattgtgggactctgctctgctgagatcaagcagattgtgtccgagtatgcagagaagcagtctgagctatcagctgaagaaagtccagaaaaattaggaacctcccagctacatcgccggaaagtcatttccttgaacaaacagattgcgcaaaagaccaaacatcttgaagagctgcgagcaagtcacaccagcctacaagccagatataatgaagccaagaaaacgctgacagagctgaagacttacagtgagaaactggacaaagagcaagcagccctcgagaagatagaatccaaagctgatccaagtatcctacagaacctgagagcacttgtagccatgaatgaaaatctgaaaagtcaagaacaggaatttaaagcacattgtcgagaggagatgacacgactacagcaagaaattgaaaacctgaaagctgagagagcaccacgtggagatgaaaagaccctctccagtggagagccgcctggtaccttgacctctgcaatgactcatgacgaagacctagacagacggtataatatggagaaagagaaactttacaagatacgtttactacaggctcgaagaaatcgagaaatagcaattttgcaccgcaagattgatgaagtccctagccgtgccgagctaatacagtatcagaagagatttattgaactctaccgccagatttcagcagtgcacaaagaaaccaagcagttcttcactttatataataccctggatgataaaaaggtttatttggaaaaagagattagtctgctgaactcaattcatgagaacttctcacaggccatggcctcccctgctgcccgggaccagtttttacgtcagatggaacagattgtggaaggaattaagcaaagtagaatgaagatggaaaagaaaaagcaagagaacaaaatgagaagagaccagttgaacgaccagtacttggagctgttagaaaagcagaggctatactttaagactgtgaaagagttcaaggaggagggccgcaagaacgagatgctgctgtccaaggtgaaagcgaaggcctcctgaacatccccagccgtggctgtatgtcattgattttacttttaagcaccgtatatcacctacaagatcatgaaatggttctgaaagcgacagtagagagatgcagttgtgatgatttcaacaacctggatgttttctttctcctctttgcttccattcatctctgttggctgctgttgatggagtcagacagtaaacacgtggcttggataacacccatcatcctatgaagaatatagggagtacttgttctctgttgattcaacttttatgtctccagtaacattgcgcttatgaaggtacctgtatttgtatggactctgaataaagaagaattcatttgtttagcaagtattagttcagcaaccactgagaaataagcactgaggaagattcagagacgtgtaaaacacagttcctactgcacaagtacccagcaggtggcccagggaggcagatacagcacacttgaccgcagaactgggctatccaagatgtttttcagtaaacagaaggcatttagctgaaatgatcagcccatgtagtgttggtcacttgggcctttcacctgccatggtaccttttgttcccagctcctccaggtgccagccagcaggcttggtggtgacagcaactggaacgaaagttcagtgttgttttaatttttatacgttactcaagttgatttctcagaaaattgaaaacagaccttgtgctgaggacacgtcaataaaaattataccttcccctgccccaatgttcatgtgagtcacagcatgcagaggggctgtgcatccccctcattgaaggcacatttgatgaggctacgctgcagatgg

SEQ ID NO: 345476 - DNA, 2384 bp, Homo sapiens
ggcaggcggcggcggcggcggcggcggcggcagagggagtttccgctttgcactccaccccggtagcagctccgcggcagggacagcttcctccggacgcttggcgggcttcgctctcgccttacgacagcccggtcggatcatggggttgcccagggggccggagggccagggtctcccggaggtggaaacaagagaagatgaagaacaaaatgtcaagttgactgaaattctggagctcttggttgcagctgggtatttcagggcaagaattaaaggcttatcaccctttgacaaggtagtaggaggaatgacttggtgtatcaccacttgcaactttgatgtagatgttgatttgctctttcaagaaaactctacgataggtcaaaaaatagctctgtcagaaaaaattgtctcggtcctgccaaggatgaaatgcccacaccagctggagccccaccagatccaggggatggattttattcacatatttcctgttgttcagtggctggtgaaacgagctatagaaacaaaagaagagatgggtgactatatccgctcctactctgtatcccagttccagaagacttacagtctccctgaggatgatgacttcataaagagaaaagaaaaggccatcaagacagttgtggacctctcagaagtgtacaagccccgtcggaaatacaaacgccaccagggagcagaggagctacttgatgaagaatctcgaatccatgctacacttttggaatatggcaggagatatggatttagccgccagagcaaaatggagaaggctgaggacaagaaaacggcacttccagcagggctgtcagctacagaaaaagctgatgcccacgaggaagatgagcttcgagcagctgaagagcagcgtattcagtcgctgatgaccaagatgaccgctatggcaaatgaggagagccgtctcaccgcaagctccgtgggccagattgtgggactctgctctgctgagatcaagcagattgtgtccgagtatgcagagaagcagtctgagctatcagctgaagaaagtccagaaaaattaggaacctcccagctacatcgccggaaagtcatttccttgaacaaacagattgcgcaaaagaccaaacatcttgaagagctgcgagcaagtcacaccagcctacaagccagatataatgaagccaagaaaacgctgacagagctgaagacttacagtgagaaactggacaaagagcaagcagccctcgagaagatagaatccaaagctgatccaagtatcctacagaacctgagagcacttgtagccatgaatgaaaatctgaaaagtcaagaacaggaatttaaagcacattgtcgagaggagatgacacgactacagcaagaaattgaaaacctgaaagctgagagagcaccacgtggagatgaaaagaccctctccagtggagagccgcctggtaccttgacctctgcaatgactcatgacgaagacctagacagacggtataatatggagaaagagaaactttacaagatacgtttactacaggctcgaagaaatcgagaaatagcaattttgcaccgcaagattgatgaagtccctagccgtgccgagctaatacagtatcagaagagatttattgaactctaccgccagatttcagcagtgcacaaagaaaccaagcagttcttcactttatataataccctggatgataaaaaggtttatttggaaaaagagattagtctgctgaactcaattcatgagaacttctcacaggccatggcctcccctgctgcccgggaccagtttttacgtcagatggaacagattgtggaaggaattaagcaaagtagaatgaagatggaaaagaaaaagcaagagaacaaaatgagaagagaccagttgaacgaccagtacttggagctgttagaaaagcagaggctatactttaagactgtgaaagagttcaaggaggagggccgcaagaacgagatgctgctgtccaaggtgaaagcgaaggcctcctgaacatccccagccgtggctgtatgtcattgattttacttttaagcaccgtatatcacctacaagatcatgaaatggttctgaaagcgacagtagagagatgcagttgtgatgatttcaacaacctggatgttttctttctcctctttgcttccattcatctctgttggctgctgttgatggagtcagacagtaaacacgtggcttggataacacccatcatcctatgaagaatatagggagtacttgttctctgttgattcaacttttatgtctccagtaacattgcgcttatgaaggtacctgtatttgtatggactctgaataaagaagaattcatttgtttagc

SEQ ID NO: 345477 - DNA, 1387 bp, Homo sapiens
taattttagtcacattttactgcaagaaaatacatattagttatgaaagttacagggaaagtatgacaaaaaagattaacatgcaattataagaccaggctaatttccatgccttctcagaggtttagcatccttaattgcctgggatcccaggggcccccgtggctccactgtgcgttacaaagacctgattgcctctcctaagagtcataatctggatacagagctgactgcttggcatttccccctgcctcagagtcctgtgtgccggtcataactctactggtttttctttcagggccatggcctcccctgctgcccgggaccagtttttacgtcagatggaacagattgtggaaggaattaagcaaagtagaatgaagatggaaaagaaaaagcaagagaacaaaatgagaagagaccagttgaacgaccagtacttggagctgttagaaaagcagaggctatactttaagactgtgaaagagttcaaggaggagggccgcaagaacgagatgctgctgtccaaggtgaaagcgaaggcctcctgaacatccccagccgtggctgtatgtcattgattttacttttaagcaccgtatatcacctacaagatcatgaaatggttctgaaagcgacagtagagagatgcagttgtgatgatttcaacaacctggatgttttctttctcctctttgcttccattcatctctgttggctgctgttgatggagtcagacagtaaacacgtggcttggataacacccatcatcctatgaagaatatagggagtacttgttctctgttgattcaacttttatgtctccagtaacattgcgcttatgaaggtacctgtatttgtatggactctgaataaagaagaattcatttgtttagcaagtattagttcagcaaccactgagaaataagcactgaggaagattcagagacgtgtaaaacacagttcctactgcacaagtacccagcaggtggcccagggaggcagatacagcacacttgaccgcagaactgggctatccaagatgtttttcagtaaacagaaggcatttagctgaaatgatcagcccatgtagtgttggtcacttgggcctttcacctgccatggtaccttttgttcccagctcctccaggtgccagccagcaggcttggtggtgacagcaactggaacgaaagttcagtgttgttttaatttttatacgttactcaagttgatttctcagaaaattgaaaacagaccttgtgctgaggacacgtcaataaaaattataccttcccctgccccaatgttcatgtgagtcacagcatgcagaggggctgtgcatccccctcattgaaggcacatttgatgaggctacgctgcagatgg

SEQ ID NO: 345478 - DNA, 1725 bp, Homo sapiens
ctcctgcctcagagcccttcccaggactgtatcattggggcagataagaggatttgctgcggggctaaggcagtgtccacggggccttgaacagtgcatccccttggaggcactcagccacccagcagcttagcttgttgcattggcgagaagattctgtgggaaggaatagggtgtaaacgactctcactttccacactgtctgactcccgtaagctgttatccttgaaaataaagtgcagtgtttggcaagatagaaagggctgtggtggcagtttgcctagagagccctagtgttagcttagtgtcctctcagctgggatccagttcccttcaaagcaccttctccctacattcctgtgggaatgccctgtaggaagagggaattttctgtgagaagaaggtggattccctgaggaaatctgtgagacagaacatgtggctaatttttttttcatatgttactttaatcttcataaacaaggcatgtgttccttgcagaagcagtatgtggagacagccaagcttgcagcagttgcagtagtgtggaaatctttttgcctgtcttataatttcgtttgtttttttacttccccagattagtctgctgaactcaattcatgagaacttctcacaggccatggcctcccctgctgcccgggaccagtttttacgtcagatggaacagattgtggaaggaattaagcaaagtagaatgaagatggaaaagaaaaagcaagagaacaaaatgagaagagaccagttgaacgaccagtacttggagctgttagaaaagcagaggctatactttaagactgtgaaagagttcaaggaggagggccgcaagaacgagatgctgctgtccaaggtgaaagcgaaggcctcctgaacatccccagccgtggctgtatgtcattgattttacttttaagcaccgtatatcacctacaagatcatgaaatggttctgaaagcgacagtagagagatgcagttgtgatgatttcaacaacctggatgttttctttctcctctttgcttccattcatctctgttggctgctgttgatggagtcagacagtaaacacgtggcttggataacacccatcatcctatgaagaatatagggagtacttgttctctgttgattcaacttttatgtctccagtaacattgcgcttatgaaggtacctgtatttgtatggactctgaataaagaagaattcatttgtttagcaagtattagttcagcaaccactgagaaataagcactgaggaagattcagagacgtgtaaaacacagttcctactgcacaagtacccagcaggtggcccagggaggcagatacagcacacttgaccgcagaactgggctatccaagatgtttttcagtaaacagaaggcatttagctgaaatgatcagcccatgtagtgttggtcacttgggcctttcacctgccatggtaccttttgttcccagctcctccaggtgccagccagcaggcttggtggtgacagcaactggaacgaaagttcagtgttgttttaatttttatacgttactcaagttgatttctcagaaaattgaaaacagaccttgtgctgaggacacgtcaataaaaattataccttcccctgccccaatgttcatgtgagtcacagcatgcagaggggctgtgcatccccctcattgaaggcacatttgatgaggctacgctgcagatgg

SEQ ID NO: 345479 - DNA, 1211 bp, Homo sapiens
ggcaggcggcggcggcggcggcggcggcggcagagggagtttccgctttgcactccaccccggtagcagctccgcggcagggacagcttcctccggacgcttggcgggcttcgctctcgccttacgacagcccggtcggatcatggggttgcccagggggccggagggccagggtctcccggaggtggaaacaagagaagatgaagaacaaaatgtcaagttgactgaaattctggagctcttggttgcagctgggtatttcagggcaagaattaaaggcttatcaccctttgacaaggtagtaggaggaatgacttggtgtatcaccacttgcaactttgatgtagatgttgatttgctctttcaagaaaactctacgataggtcaaaaaatagctctgtcagaaaaaattgtctcggtcctgccaaggatgaaatgcccacaccagctggagccccaccagatccaggggatggattttattcacatatttcctgttgttcagtggctggtgaaacgagctatagaaacaaaagaagagatgggtgactatatccgctcctactctgtatcccagttccagaagacttacagtctccctgaggatgatgacttcataaagagaaaagaaaaggccatcaagacagttgtggacctctcagaagtgtacaagccccgtcggaaatacaaacgccaccagggagcagaggagctacttgatgaagaatctcgaatccatgctacacttttggaatatggcaggtaatgagtgggacccagtctaggtgtctcttttaaaagaaaagctaatttaagttgcttcatttggattaacttgactagcttctacccgattgagtttctgccttcagccatgagatttccaacatcagggacttttctctggtaatgaattacctgtttctgtgggcatcctttgcaattcctctctggaaatgtgcacctggctctgccttcctttgggagttggggtgttccaggcatttacagaggctgaggtactctgtcctgcatgcccctgtttgttaaaatcttcaggtaaatgaaaacagtttcagtgatttcactttaagtgttagaataataatttcaatttcctgtgaatattgtcctaactaggaaaatgaagaacttagaagtagttttgtcacttcttaaaaacatctcgtttaaaaaaaaaaatcttattt

SEQ ID NO: 345480 - DNA, 401 bp, Homo sapiens
atggccatgttattcccctatttaagactttttgatgatacctgttgcctatatgatattgacataaccacagttatgtccctgtacttttttacacatgctgttccctcagcccagaatgcaggttctgttgatagggattttggtcattgtgtcagaatctcttctgtacgccaggttttgaacaggcctctgtaaatgccctggcttggtgtgactggctgcccagtactgctttgcccacattgaacagggcttgattacatgaaccaaggtcaactaactaaatcctttggatttgccatcccttttttccacagcagtctgagctatcagctgaagaaagtccagaaaaattaggaacctcccagctacatcgccggaaagtcatttccttgaac

SEQ ID NO: 345481 - DNA, 276 bp, Homo sapiens
tattttggctccctagagaacatgtaaggccttttaccaaatagtactgtctctgtctcccttttgcatttaggctcgaagaaatcgagaaatagcaattttgcaccgcaagattgatgaagtccctagccgtgccgagctaatacagtatcagaagagatttattgaactctaccgccagagtaggtgcattgaccacagacaagctcttgaggctgggaagggacaggcgaggggtctgttccactttagcatgggggagcatgcaccagagca

SEQ ID NO: 345482 - DNA, 2267 bp, Homo sapiens
attcaggaggagagccttctcacactcagtaacttggctgtctcatccacttaggaagtgtacaagccccgtcggaaatacaaacgccaccagggagcagaggagctacttgatgaagaatctcgaatccatgctacacttttggaatatggcaggagatatggatttagccgccagagcaaaatggagaaggctgaggacaagaaaacggcacttccagcagggctgtcagctacagaaaaagctgatgcccacgaggaagatgagcttcgagcagctgaagagcagcgtattcagtcgctgatgaccaagatgaccgctatggcaaatgaggagagccgtctcaccgcaagctccgtgggccagattgtgggactctgctctgctgagatcaagcagattgtgtccgagtatgcagagaagcagtctgagctatcagctgaagaaagtccagaaaaattaggaacctcccagctacatcgccggaaagtcatttccttgaacaaacagattgcgcaaaagaccaaacatcttgaagagctgcgagcaagtcacaccagcctacaagccagatataatgaagccaagaaaacgctgacagagctgaagacttacagtgagaaactggacaaagagcaagcagccctcgagaagatagaatccaaagctgatccaagtatcctacagaacctgagagcacttgtagccatgaatgaaaatctgaaaagtcaagaacaggaatttaaagcacattgtcgagaggagatgacacgactacagcaagaaattgaaaacctgaaagctgagagagcaccacgtggagatgaaaagaccctctccagtggagagccgcctggtaccttgacctctgcaatgactcatgacgaagacctagacagacggtataatatggagaaagagaaactttacaagatacgtttactacaggctcgaagaaatcgagaaatagcaattttgcaccgcaagattgatgaagtccctagccgtgccgagctaatacagtatcagaagagatttattgaactctaccgccagatttcagcagtgcacaaagaaaccaagcagttcttcactttatataataccctggatgataaaaaggtttatttggaaaaagagattagtctgctgaactcaattcatgagaacttctcacaggccatggcctcccctgctgcccgggaccagtttttacgtcagatggaacagattgtggaaggaattaagcaaagtagaatgaagatggaaaagaaaaagcaagagaacaaaatgagaagagaccagttgaacgaccagtacttggagctgttagaaaagcagaggctatactttaagactgtgaaagagttcaaggaggagggccgcaagaacgagatgctgctgtccaaggtgaaagcgaaggcctcctgaacatccccagccgtggctgtatgtcattgattttacttttaagcaccgtatatcacctacaagatcatgaaatggttctgaaagcgacagtagagagatgcagttgtgatgatttcaacaacctggatgttttctttctcctctttgcttccattcatctctgttggctgctgttgatggagtcagacagtaaacacgtggcttggataacacccatcatcctatgaagaatatagggagtacttgttctctgttgattcaacttttatgtctccagtaacattgcgcttatgaaggtacctgtatttgtatggactctgaataaagaagaattcatttgtttagcaagtattagttcagcaaccactgagaaataagcactgaggaagattcagagacgtgtaaaacacagttcctactgcacaagtacccagcaggtggcccagggaggcagatacagcacacttgaccgcagaactgggctatccaagatgtttttcagtaaacagaaggcatttagctgaaatgatcagcccatgtagtgttggtcacttgggcctttcacctgccatggtaccttttgttcccagctcctccaggtgccagccagcaggcttggtggtgacagcaactggaacgaaagttcagtgttgttttaatttttatacgttactcaagttgatttctcagaaaattgaaaacagaccttgtgctgaggacacgtcaataaaaattataccttcccctgccccaatgttcatgtgagtcacagcatgcagaggggctgtgcatccccctcattgaaggcacatttgatgaggctacgctgcagatgg

SEQ ID NO: 345483 - DNA, 1438 bp, Homo sapiens
ggcaggcggcggcggcggcggcggcggcggcagagggagtttccgctttgcactccaccccggtagcagctccgcggcagggacagcttcctccggacgcttggcgggcttcgctctcgccttacgacagcccggtcggatcatggggttgcccagggggccggagggccagggtctcccggaggtggaaacaagagaagatgaagaacaaaatgtcaagttgactgaaattctggagctcttggttgcagctgggtatttcagggcaagaattaaaggcttatcaccctttgacaaggtagtaggaggaatgacttggtgtatcaccacttgcaactttgatgtagatgttgatttgctctttcaagaaaactctacgataggtcaaaaaatagctctgtcagaaaaaattgtctcggtcctgccaaggatgaaatgcccacaccagctggagccccaccagatccaggggatggattttattcacatatttcctgttgttcagtggctggtgaaacgagctatagaaacaaaagaagagatgggtgactatatccgctcctactctgtatcccagttccagaagacttacagtctccctgaggatgatgacttcataaagagaaaagaaaaggccatcaagacagttgtggacctctcagaagtgtacaagccccgtcggaaatacaaacgccaccagggagcagaggagctacttgatgaagaatctcgaatccatgctacacttttggaatatggcaggagatatggatttagccgccagagcaaaatggagaaggctgaggacaagaaaacggcacttccagcagggctgtcagctacagaaaaagctgatgcccacgaggaagatgagcttcgagcagctgaagagcagcgtattcagtcgctgatgaccaagatgaccgctatggcaaatgaggagagccgtctcaccgcaagctccgtgggccagattgtgggactctgctctgctgagatcaagcagattgtgtccgagtatgcagagaagcagtctgagctatcagctgaagaaagtccagaaaaattaggaacctcccagctacatcgccggaaagtcatttccttgaacaaacagattgcgcaaaagaccaaacatcttgaagagctgcgagcaagtcacaccagcctacaagccagatataatgaagccaagaaaacgctgacagagctgaagacttacagtgagaaactggacaaagagcaagcagccctcgagaagatagaatccaaagctgatccaagtatcctacagaacctgagagcacttgtagccatgaatgaaaatctgaaaagtcaagaacaggaatttaaagcacattgtcgagtaagtgttgtttggtgtcagcaaataaaccaggacgcttattgaatctcttggtttacctccgttgtcctg

SEQ ID NO: 345484 - DNA, 358 bp, Homo sapiens
ccttggatatcaccgcaaagatccatgtaggcatattgcttctgtcttacatgttcagaaccactcactgctgctcccttccattcctctttcagcagcgtattcagtcgctgatgaccaagatgaccgctatggcaaatgaggaggtgagtgggagtcggggaggtgtggggatggggacttggcaccaccctgctctgctggggtcttctcccagagagcccaccttctccggagctgcctctcaccagcacacagtacctcctcttccccagggagttccttttgttaatctgtttttaatgcctagtgctgccacccatgggaacctctaggagggaggcttgaaggacccttg

SEQ ID NO: 345485 - DNA, 1063 bp, Homo sapiens
aatcaagatcagatttatgcaggtgaagaattccttacgctttaagtcattttccatctccaggctagcagttcagttgatttccaggaagaggaatcaataaggtagatttatttttaatatatggatatccatagagtctagcttagtcttttggtaagttaaagtttgctagtcggacctgctataggaattcttttttgttgctgtttcctcctccctcagctagatacaagattaggtaggcaggaggttaggcggccagtctaggtccagaaaagtagatcaagtgggtagcaaggtgagccgcaaatcttagctgggcctgagtttgcactgttctgctctaagggccaacaaataaggctctattaaaaattatttaactcatctaaactatacaaagttatttgatttggtcagtttccttggattggagaaatttaaaatgacttaaattaatgtgtaatacttagtagtaatgtcaaatgtttaaacctggtatgtaaattagtcaagcaacggcctttcctgtctgtttggtgcagctgaacacatgggtctatataaagttcttttgctctcaaatataaatagcagctcaaaagatagctggaaggttgcaggaagttcttagcaaggtcaaaaacaattctcatgtgaagccatggtgatttcttaccgtttgctgtcatgataattattggggcatataatcggatgtgctcttcaatcatttcgtgagattttcagccaacaataaaagggttttgttttgttttgtgttttggtagcagtggtggtggtggtggtggtggtggtaagtatccagtctcttgaccaggggtgttagactcttgggtattcataaggttttcccggggcctggcagggcctcctcctgactcccaatcgttcctggccatcctggaagctacctctgcatgttccacctccgcatgctcccagagctgtgctgtcattcttgatgcttttatttacaccgatactgactagcatatagatttggagggggaaaataaaaagttatctatgataaatt

SEQ ID NO: 345486 - DNA, 643 bp, Homo sapiens
tacaaattatgtggatggttgataggtattacgtaaagaagggcttccttggtgtcagtggaaaaactcagagataaatgttaagaaatattacattccagttttgggatttgtgaagaaaaaatgaagagagcaaagaaaaaaggaaaaaaaataaaaagaaatatgttgtttgcaaggaaatccagccttcaaaagaactgggttccctgaatgaaggcttcagcagttgtacaagggggaaaaaacaaaaaagttacacctaatctgtttattagtctcattgatgaaaaagagcagttttctcacatgatgacccaaccttcaggggttatttaaatggctgtaaatatcagcattacgtaagttagagacgtgtaagttgtttttgtaagagaattggcatttataggaaaggggcttggggcttatattggggattgatgttaaactgaaaaaggatgattccatgttttttggtggcctttctcaggttacaaagttgttttctctgaggtacttgaaggggatgcttaaagttttgtgaataaggtgattggtgactattagctttttaatttttttacaaacattttcttataaaaatattttatttatttatttatgaggtggagtctcactc

SEQ ID NO: 345487 - DNA, 273 bp, Homo sapiens
ctatcaactgatttgaatcacatactttaatgtctgaggccatatattctactatgtatgatctacacagttttgagatgttacatattcatgattcatttgaaagtgtaaaaaagggtactttagttttaccctaatggctaaatatttaaaatactgttatggggctgggcatggtggccactgtaagcccagcactttgggaggctgaggtgggaggattgcttgagccaggagttcaagcctaggcaacaaagcaagaccttatctctc

SEQ ID NO: 345488 - DNA, 249 bp, Homo sapiens
aggtgttcttatgagagaaaggcagagagggagactggagacacagagacacacaggggagccgactgtgtgaagatggaggcagagatgggagttgtgctgccacaagccaaggacaactgcaataccagaggctgggaaaggcaaggagacattcaccccaagagccttcggaggcagtgcagccctgctgacatcttgatttcagccttaggagaataaattactgttgttttaagtcaccaagtt

SEQ ID NO: 345489 - DNA, 388 bp, Homo sapiens
cgttaagcagtgagcagctgaagcaaagacgttttctcccttccagatctataagtagtaaggaaggcagtgtggctggggcccctaggagtttgcactatggcaaggcaaagcaaggaggcaatgtgaacaccaagcagaaggagtcctatgaagaggcagatgtgctgtcagggtgcaaaaccacgtcgtattgaggcagttgatataaaggatgttccgcgaatgactttttcccactcatggcctatactatcaaaggggagaggtgtggggtttactgagccccttgtgctgcgtactgtaactcaatcctcagtaccactgcgacgaggtaaaaatgatgattcccattttacaaataaagaacctgtggccagtgcaattt

SEQ ID NO: 345490 - DNA, 300 bp, Homo sapiens
agtttcataaatcttgtagttatcttgtgcataacataactatgctgcatcttgggggtcaaagcactcctgtgcggtggtgttcatgggtgttagcatttctttcttctgaagcaatccaggaggctcagaaaaccacagcagctgggtcctggaggcggattctagggaatgactctccctggcttcccccaaggcctctctgaccctgtccagcctctcccccactccctggaggtcaggagtgtccactctggggtcaaggctgggctctgcatctgcacccgtgtttgtgactct

SEQ ID NO: 345491 - DNA, 627 bp, Homo sapiens
ccatctctttatgaatgtatgtacatatatatccccagataggtgtgcacagttttacacgtgaccttatactattctgactattgggtaccttgcttttcttagacctttccccatgtcggctggtgtggttttatataattcttaatggctatatggtagctgtttctatgcacataccatagttcaaccagtgctgaactgattgacatttgtggtttatagttttttgtctgagtgaatacaacttttggcattagtgcctaactctttagataagttaaagtcttagaaatgaaagaactgttttaaagtgtggatacacagattgtgagatctaaataagtaattatgaaagagaagaaagtttacagaaatgttgagcctttttcttaggaagctgtcaaattcaaattggtattcatagcctccggtaccaaccactcagccatcaaaaagtgttgagaaatcttacacatatataaaagaaaaaaaacttcgaggggggggccccggacccttcggcctattgtgaggcgttttacaattcactggccggcggtttacaacgtcgtgactgggcccggcggttacccaactttgcctttgagcacattcccttttggc

SEQ ID NO: 345492 - DNA, 351 bp, Homo sapiens
atgatgaaactaaggatcccagaggctgagtgacttccccggagtccctcggtgggatcgttgattccttttccacaactggaaccagaggccagaagagatggccccccgaaggaccaggactaggacacgaaggcaggtttcgggacctcagacgtctacagtaaccacgctgcgcgaccaacacctaaggatgccccggctccagactgagacccaagtctgacttccccctgccagttgaggctccttgcctggttgctgcgacgattcgagatgggccttacccgggccccacgcgtgtcgcaggcacgcagcacgcacgcttagtaaacaccagctgtagtgagc

SEQ ID NO: 345493 - DNA, 428 bp, Homo sapiens
ccattccattccattccagtccattcaattcaattcttgtccattccattgcattccataccattctagtctattctgttctattccattcgagtccattccattgcattccatacctttcgagtctattccgttctattccattctagtccattccattccattagagtccattccattaaattccattgtattccattcgagtccattccattccatttggttccatttgtgtccattccattccatttgaatccattccattccatttctttcgagtccattccattccattccattctattccattcaagtccattccattccattcagttccattccattccgggtccgttccgttccattccgggtccgttccgttccattccgggtccgtaccgttccgttactgatctataggagtggtg

SEQ ID NO: 345494 - DNA, 477 bp, Homo sapiens
ggcctgtcatgtgaccagtagagagtagagtgagcagccgtgggttttctaggccaggagaggaggagccagcatgtagcttgtgtagtctccttttaaagatgctctttgctgaggtgccttttgcacttaattgaaatcagctggagtgagatgttttcttaagtcatataagatacatagtaagaactgagaaagcaattttcttttatttgaacccctccacccgtcacttcaagataggctatttgtgtttgtagctagctgtgctgttctcttggatacccgtgattttagctgactcaggttctcaagtctgaatatattgtacttgcctttcagtgacatgccaacccaatttcccacggggcaggtggaggcgtttaatgttaattggggaaaaaaatcaatataagtcttttagaattattcctttttttctttttggagacagggtcttggtctgttgcctggact

SEQ ID NO: 345495 - DNA, 224 bp, Homo sapiens
tctaactaataaactgctgtgcttgggcctatttttatgttaacatgaattattcttagcgtatgcttaaaagattactcccactatcttgatggttaagcatgcaagtgttcaaggttacatgtacacatgtgcactcataaatgtgtaagtgagtatgtgtactattgggccatctgaagtggaatttcatccaagcatccagactattaaaaaagtgacta

SEQ ID NO: 345496 - DNA, 193 bp, Homo sapiens
tctgtgaatctagaattctctatccagaagtatccttcaagcataaaggtgaaataaagacattttcatgtagaagaaaactaagatgattaatcgtcacatctgcgtgccaggaacaggtaaaggaggttcttccagttgaagaatggacacttatcctcagcaagcaaacagcatcagctgtgactagtat

SEQ ID NO: 345497 - DNA, 645 bp, Homo sapiens
atacctcaatattttttcacacatgaactaaagaaatgttggaggctgaaagattgagggtcgtgattaactcagtatcctaccactggaggctatatgagtaaacaacaaactgttctcataaatgcagaatgttggcaaactgacaaactgcgtatgccacccataaggaatgctgagggcagtcatgtcccaagtgcaatgtttcttgagattcggtacatctgaagcctgttagtaataatatgaacctgtgattaattaagcagctgaccaatcattacctcttcctccttgctcttgttacccaataaatacgaagggctgtagaagctcaggcactgcctttgctcactagaagcagggagccctcttcttcttcccctggccccttcctttaaaacagttacttttgtcttaagttttcatttctagttcatcccccttcactcagtctcgtaatgacagtctcaagtagtaacagttgtagtgaaggtctcaagtagtaattgtggcagtctgccacaaagaaacatttacagagtgccccagatgtcttacttgtgtgccctcctactcactacctcttctccagaatacataaccattatactggcttctcacaccatacgttttgtttgaggt

SEQ ID NO: 345498 - DNA, 529 bp, Homo sapiens
gtctggtctgaattgattttcttcccaaagaaatcaggcttataaacaagtggtcctatttgaacatcaaatttacctacgcattgcaggttatctaataagtccatgcacaggcatttttaacatccccacaaattaatctattatatgcacttcttttcttctccaataaatcttaaatctacaaactaaaggcccaaatcaaatgattgcacttcatgaattctatagcatccataatggatgtggctcctttgttattttgagcacgcagggtgcaactttgaaaggttagctaatgtattttttgttgctagaaactatttgtcctctatccttccctcctttccaggcagctgcctgggcattaggttttactaacttctcctgaggatgatgtaaccaaaccaaagagttgattcttagtttttgggtttcaaacgcttgggctttgaatttcataaggcaaaactaagaaagactttgggaccatacaattattccaaagccactgaagtgtatgtaaatg

SEQ ID NO: 345499 - DNA, 337 bp, Homo sapiens
tccaagattaggtaatgagacagcagcttgatatcatgccgtctgaaagaagccatgttgtgaatgaagagacccatttggtgaacaatggaagcaccctgccaagagccatatgagtgaacctggaagtgatcctcctgttactgtcaaatcctcagagtcaggaatcccagccaaaaccttgactatatcctcatgataggctgtgagctagaaccacctacctacgccattcctggatttctgatcatcttctgaactgtgtgagataaatgtttgaagttgctaaatttgggagttggggggcacaatttgttatgcagcagtaggtaactaa

SEQ ID NO: 345500 - DNA, 354 bp, Homo sapiens
gcttctcccgcttggttgcttccattattccccaactgcggaaacaccagccaccatatgtccgccggagaataagcgtgagtgtcgcggtggacagttgccgccaaaggtgtccagacggatggcattctcaaagtagggatcttagcatcctctccatacatcatcacccaagaatggtagaggaaagagtaggagtggggttacagataggagagaaaggaggttgaggccacaaaattggcatttctctaattatcaaccccctcctccaccatcctgccaccatttgttatggcaaagttctctttctgtgccccttccctaataaagaaatcctcagtcagcctccac

SEQ ID NO: 345501 - DNA, 211 bp, Homo sapiens
cactttcaaaaaaaagggaagaattgtcagaaagcattgtctaatatgccaaattttaaatcataattattaattcttcaaactaatttctagaggaccaggatgactgttagctcatattcaggtctctgaaataagaattgagcattgtttttattgctttagttacaggagcttgtgggcaacatgtctcactgaggcatttataagg

SEQ ID NO: 345502 - DNA, 796 bp, Homo sapiens
tgaaagaaaccagattcaaagagctagaactgaatggttccatttgcaggccattctagaaaaggcaaattatcactggtttttaggatctgggtttgaggcgatgagacggttacaaaggaaacttttgggagtactgtaaaagttttctatcttgactgtggtagttttacatgtcaaaactcagaatattatactaagaaggataaattttactatatgtcaatcagacctcaatgagcctgacactaagaaaaaaaattaacaggaaaaacaattatatagtaattatgcaactaatttgttaaagaatgaattataacgaatatgaatttgtaaccacaaacccaagtgcagaagtcacacttcttaattacaaaataaaagaattatttaaaaatacactttcagatgtatttgtttacttctcactgggcatatataccaattttaaatgttccatggcataagcattaatttgtcagtaaaataattatttaaataggaatactgcatacattagcttttttctgaaactactttcattagtttctaaataggcccaatgttttcatgtgcctttgctataaatgaactaaaaacactgctcttatagaatatattaagtagagaattaatttactactgatgctttcatggttttagatttttcaaatacctggaataccatcatccacttattggtcccctgcatttcagaaatcttattaaaatggtacttaaatagctctcttacactgcagaggcaggtgtgtgtttggaagttggcgggaaa

SEQ ID NO: 345503 - DNA, 304 bp, Homo sapiens
tcttcctaccacgctatatcacaaagactccctagagacagtgcaaacccatggccaacctcgactattagtccacatcaaagatggctagaatgactgggagagagaaaagcaacacagatggcctctggccctcacaccctctcctgctcattcccaagcccgcagtggtctctgaatcggctaggcttgccgctgcttccttctgtaacctcagtgagatatatcaacctggcctggctatatccttggggtctccaacgtctccagtgatgtccagaaatcctcaaaaagttctaacaat

SEQ ID NO: 345504 - DNA, 466 bp, Homo sapiens
gacagttctgtacagaataagagtcacataagatgtgatttgttaaagattatagaaatctcagaagatagattatggatgaaaatatttgtttaatttagagtactaataataaaaatagtgcattttacattttaaaaagaaaacaatttttattgtgtcatattttctgtagtaacaaacagaattaattatcagtaatacaaatttcatctgctttaatttattgcctgtttttgaaattagaataatgatatatttggtttaattatccattacaaattgccttattatttttcattcatctttcaccattaatccagaaaccttaaaatagcttttattttgacccatgccttcagtagatatcaacagacttgagttcatctatggatcctattagtttaaactgtgacaaattttgactgcttaagctttagaaaagaatttattctttaaaatagcc

SEQ ID NO: 345505 - DNA, 362 bp, Homo sapiens
tacttaacgtcttcatgtattaactgtgtgagcacagacaggcgatttgaactcttcagactttagtgtcctcatctacaatgcctagctgatgacactgggttgttgtgaagaacaagtgaagtaacaaacatcaaaacgctttgtaggctggatgtggtgcctcacacctataatgccagcactttggaaggtggaggcaggtagattgcttgagtccaggagtagattgcttgagaccagcctaggtagcatggcgaaaccctgtctctacaaaaaatacaaaaattagccaggtgtggtggtgtgcacctgtagtcccagctactcaggaggctgaagcgggagtatcacttgagccc

SEQ ID NO: 345506 - DNA, 203 bp, Homo sapiens
aaatgggaggaggcagattgcctgacaatacagaacaaatagcacaatagaggaagcagctggtgaatcttgtactcaggagacaagtgaagaggaacactagagattcatttctatggtgacagggtcccatttcagtgtccttattctgaaagtaattttggcacttttattggaaaatagtgagatgttaaacttagaaa

SEQ ID NO: 345507 - DNA, 452 bp, Homo sapiens
agttgtccagccgttctctctcctttcttacctcttcctgccttcccacctctctgcatcctcacccttaatggtcacaatgccgcatttccagggtgaccccaggttccctccccgtggctcacagtgctggtcaaagcatttgagcccccaaatgccccactctccagatcggagtgtaaagtagtaggtgccagtcctgctccctcgtggggctgggcagtgagctctccctaacacacacaaagcacctccagctcagaggaagctcacacctcccatccatgccttcaggcttttcggcactggcatttagaaagctattctctggattcagaacccccagagagagcttttctctgtccttcctgattattggtgtgtaaatgaaggcctagagtagtggttcttaaacttgagcgtgatgagagtcacctggggaggtgttggaa

SEQ ID NO: 345508 - DNA, 114 bp, Homo sapiens
ggcatgtatttggggctctgcttagtaaacatttattttagaaatgttatttgtggaaagagagcttttatacatttttagctgacaaatttatttttctcccatgcttcctat

SEQ ID NO: 345509 - DNA, 183 bp, Homo sapiens
tccccatcaaaatataaaaataaataagtcagttaatctgaaagccttgactagaaggccaatgacagccatatttctgagagacgcagagcttcaatctgagagatagaagagtatctgaaatccagcagcaagagagaagaatctcctttattattgacaactcagggtttctggccatca

SEQ ID NO: 345510 - DNA, 533 bp, Homo sapiens
agctgggtgtggtggtgcacacctgtaaatcccagctactcgggaggctgaagtaggagaatcacttgaacctggaggtggaggttgcaaaaaaattgaaatacaaacacaatggatgggtgttataatagtttaggtacagcaaagaaagtaaattggaagatagaactaaagaaattatatggaaaagaaacacagaggggcatggggctgaaaaatagtttaggacacaggaaggatagagtgagaaaatcctctctaactggagtactagaagaaaaataaataggatgggcaggagcagtgtttaaagaagccctacaaatacccagcaggatcaaagggaaaaaaatccacatattatagacagacatcatagccaaagatcttaaaagtagtcagaaaaaaaggcattgccttcaaagaagaccaacgactgatttcccagtagcaacagaggaagccagaagacagtagaatgattcctaaatggttccgaaagaaagtaactatcaatctagcattctatatcc

SEQ ID NO: 345511 - DNA, 335 bp, Homo sapiens
ggttcaagcaattctcctgcctcagcctcccgagtagctgagactacaggtgcatgccgccatgcccggctaattttttgtattttagtagagatggggtttcaccgtgttgccgaggctggtctcgaactcctgagctcaggcaatccatctgcctcagcctcccaaagtctggtgctgggatcacaggcgtgagccactgcgcccggccacattttttttttaatgcacaaaatttcaaaattgattttaagccaggtccccaagttttttaaagcaactgctgtctaaaaatgcaaatcaaaaatgtctggtgagaaactcggggctgtggc

SEQ ID NO: 345512 - DNA, 350 bp, Homo sapiens
cctcagtctccttacagattctattattatacctgacagtcacagaaaatagaatatatgttaacagcatcccactggtgcctagaagccgttatctcccaaaacctcggtagggggagccatttctctactgaaattggaaatccagctttttgaacacctgttaactttgaatttgattgggagcagttgtgtttgtccacgggaatgtttttcttgacctaatcttgggatcagccccctttccctgcatccgtatttctggagttgctactgcagggggtgcccacaaggaagtttatactcacgtttcagctgattagataaacgcttaagaacaattttatttt

SEQ ID NO: 345513 - DNA, 417 bp, Homo sapiens
  misc_feature (159)..(159): n is a, c, g, or t
gtctctactatctgttaactaactagagacataactcacaatatgcagtccccactgagtgttcaccataatttgagattcttggcatgttaacttttcattatggaatattgaataatttcaatattattcatacatttcttgatgttcaaacatacncaaaaatagaataatgaaactctacccatcatccagcctgggtgacaagagcaaaactcagtctcaaaaaaaaaaaagaaaaaaaaagatatatatattcctactcttattaaatgaatatagcatttcttagcaacttcttttgatttgtgagtatatattttcttggcctcaaaattaaagtaaaaagtatcctcttactcagaggaggacaggggcaagagcctgggtgacaagagcaaaactcagtctcaaaaa

SEQ ID NO: 345514 - DNA, 550 bp, Homo sapiens
  misc_feature (159)..(159): n is a, c, g, or t
gtctctactatctgttaactaactagagacataactcacaatatgcagtccccactgagtgttcaccataatttgagattcttggcatgttaacttttcattatggaatattgaataatttcaatattattcatacatttcttgatgttcaaacatacncaaaaatagaataatgaaactctacccatcatccagcctgggtgacaagagcaaaactcagtctcaaaaaaaaaaaagaaaaaaaaagatatatatattcctactcttattaaatgaatatagcatttcttagcaacttcttttgatttgtgagtatatattttcttggcctcaaaattaaagtaaaaagtatcctcttactcagaggaggacaggggcaagagcctgggaccttatttgctaattaaaatgcacacacacacacacacacacagaaattttgagagccattttaatataattgcctccctagaaacataccttttagggaatttttatcactaaaccacatgttatttaaatacgtacatgtttaacataaatacataca

SEQ ID NO: 345515 - DNA, 267 bp, Homo sapiens
ccttggttgtgcagacacaatcttaaactactagcattatgcgtcagcttctgaaactaaaatatgtttttaaaaagagcttttaaatacattcagcttacttttctctagcactgaaagccataacataaaaaagtgagacaggaatgtttttttaacagcaaagagatgctttgtatccagaaaagctgaacaattacagtgtagctaaaatgttctttgaagtactgtatagcacttaactttaaaagctctctgcttgcttct

SEQ ID NO: 345516 - DNA, 480 bp, Homo sapiens
aggctggccaacatgtgaaaccctgtctccattgaaaatacaaaaattagccaagcgtggtggcagatgtctgtaatcccagctgctagggaggctgaggcaggagaattgcttgaatccaggaggcggaggttgcagtgagccaagatcgtgccactgcactccagcctgggggacaagagtgaaattccatctcaaaaaaaaaaaaaaaaaaaagcaaataaaaaaagattcacctttgacacagtgggctaagtaggatgatctgtcctcaccaatgccagtgggcatcatccatcccattgaggacctgacctgggtagaacgaaaaggtagaggaaaagtgaattttctctctctctatccttgagctgagaaatctgtcttctcctgcccttggacatcagagttccttggttctggacctttgggctctaggacttataccagggcacctgctcagcattccaccatccccac

SEQ ID NO: 345517 - DNA, 360 bp, Homo sapiens
aaggaccagccttaagctttttgaaagtgggatccttctggcacatgtccccttctttgcaaccatctttgatgccatgctagtagagacaggactctgatctactgaaaactgagaaagatcaaataactaatatagctaataagcatgcctcacatattcttgctcatttcgagttttggtaatagtaagacaccgtaccaatactgaagaacccagaacagagcgtcaatcctccattgtgctttgatatctcagatataaacaaaactctgtcatgtccacatttgctaggctaaaaatgttaggaaattgtatgtagtaatcagaaatacagactgccatggacagagccaaaac

SEQ ID NO: 345518 - DNA, 598 bp, Homo sapiens
acgccgccgcttgtgctgcagccatgtctctagtgatccctgaaaagttccagcatattttgcgagtactcaacaccaacatcgatggaacgattcggaagcatagcacatgtatgcaccatcagcatgacacgatatgagagagcgtagttgggtgcccgaaccgatatggcgtcactgctgggctcgatctgtaggcgaagacagtcaatgtacaacttggacctcacctcataggagggacgggagaacctaagctgagggatcgagggttgagaaagttgctggtaatctatccattaatgtcaagaatcgcacgccagtacaagatcccagactggttcgtagaatagacaaaagacggatgtagaagtgatcggagaaagtaacagcgaaggtcactaggtcacaaatggtatggacagacaagctcagcgaagatcgtggagcgatcggtagtagagttggggcgccatagacgggatgacgctcacattctggggcttaattagtgtcggaggccacgcacacgtacgaccaccgcgcgccatgtaagcaccgtgggtgtgtcacaagaagaaatataaatcgatgcctg

SEQ ID NO: 345519 - DNA, 821 bp, Homo sapiens
  misc_feature (784)..(785): n is a, c, g, or t
aatttgtgagcaattgaaatattacatttccaaaggatctacgtccaactcttggtgtccactaataaatgctctttctttggattactttatttctctttgtagctctgtttcctattttgtagtctcccatttccatcttccttcttacacttccatctagttgactactgacaccactgaaccaaaattttcatctttcctcttaaatgtgttcaacttctgagctcttctttcactctttgacttgcttggcccctagatttgatcactcacacatcctgaaaattattcctcctgaataattctgaaatccattcccagagtctccattcttactggaattgcaggcagaagaaattgcatgagccacaaaggaaagaaagacacctaggtgtgttaggggagcggagtcatggtagagttagggaaaggacatgaaaatcattactgccatgtgattctgaattctgttttccctaggttacagtgaatgacaatttaagaaaataattgggatgcaaattgagaaagatatgtctcatttaaatttttttctaccatttacagaacttgaaggtctcttcacagactaatttcttatctcgagcatggtggttccccatcttttatttttttgagaaaaatgtacaaggctcaattccttgctgcttctcctggccgctgtcttggcctcctggctgcttcaaatcatcatgcaaaaagtattcacgggttcagaagattggtgaagacaatgagaaatcgtacttgatcttccaanntatttaaatatttgaaaaaacatacgaaataataaa

SEQ ID NO: 345520 - DNA, 1959 bp, Homo sapiens
aatttgtgagcaattgaaatattacatttccaaaggatctacgtccaactcttggtgtccactaataaatgctctttctttggattactttatttctctttgtagctctgtttcctattttgtagtctcccatttccatcttccttcttacacttccatctagttgactactgacaccactgaaccaaaattttcatctttcctcttaaatgtgttcaacttctgagctcttctttcactctttgacttgcttggcccctagatttgatcactcacacatcctgaaaattattcctcctgaataattctgaaatccattcccagagtctccattcttactggaattgcaggcagaagaaattgcatgagccacaaaggaaagaaagacacctaggtgtgttaggggagcggagtcatggtagagttagggaaaggacatgaaaatcattactgccatgtgattctgaattctgttttccctaggttacagtgaatgacaatttaagaaaataattgggatgcaaattgagaaagatatgtctcatttaaatttttttctaccatttacagaacttgaaggtctcttcacagactaatttcttatctcgagcatggtggttccccatcttttatttttttgagaaaaatgtacaaggctcaattccttgctgcttctcctggccgctgtcttggcctcctggctgcttcaaatcatcatgcaaaaagtattcacgggttcagaagattggtgaagacaatgagaaatcgacctgaggagcaaaacaaaggcatcagctcttacaccaaaagagttaacgctgtaaccaaaggtatagttttgttttttattttaggagaactgactggtaaatgaagaaatggaccaaattttgtgtaaacgattagaaagatgaacaaagtattgccctttgactggttttcttcttcatcctgagaaagatacattctcttgcagctcttcattcattggtgacaagcccccaccccgggactttactaatgagcttgttaaagaggtgccaaagaacatattcctcctttctttattctttctccaccaaaaccctctacttcagaattttttcaggatatttttcagcccaaggtcagaagaatgtgttaatattttaaataaaatatctggacatctacagccactgtgtaaatagaactgcctaatgttgagagtggtttttagcattaggtttagcaagggggagatccgtgggttgtgcgtcagctttgggtgaattttgtttctaccctgtcacggggaaagttcgggttgagtccaggagtgcacactgctgctgccacccaatgcgctacgtatcactttttttgtgttttgttttgttttgtttttaaaagatcattttatcttaaaaaggaaagctgatccaagtaaacacgaaagtatttgacacaccccacagattttacatgtgtgtaaatgtttcactttaaaatctctatgacagatacacaggaaacatgagatggtttctgctaatgagtggcccttgagtacacacttagatgctgtctgccctgtaaatttggatctggtgccccagggcagtcaactcttctagcacaggctgaaaacacgtgtgtgtcaactgaggttcacaccacttggggaatgagcctgttttctttccaggtcaggccctggtgtgagatcaattttagggctcctaattggagcacagaaatgtatttggtcaaatttcattgaaggtgatttcttcctttttctgttgtacttcatggaaaaaccaagatggaacctgaaagttaatgtatccttgcttttagcaagagactcagtttcttataactagtcctaaggacatatgccgcaattgagtaattttacttttaccctatgaaaataacatggtgctgcactataatatactctcggaatcagtg

SEQ ID NO: 345521 - DNA, 1489 bp, Homo sapiens
cccacctcccccaggcccagccccagggccccctcaggacatttcagaacctccaggggggtcgccactgccatctccaccttccacagcacccccaccacctcccctgctgctggaacccccacctcctgagccaggggttctcttagctctactccaacaaactgtgtctttaaggatctgggcacttgtttcttgtggggggtgggaggtacacagcaggtgttgggcgacctgactcagacacagaggagtctttgatccccaaagaccaacgatgagaagcagtggcccaggaagaccgagagtgggcttctgtttcccaaagcgctggtgtgactgtggactgtttacacgtggggggtgggaggggaaggagggtagagagaaggaaccattaaggacctgggcgctgagtttctgctctctggtactatctgctttagcaagagttatttaaaacagttttacaagcacggcctactgagcaggttctgaaagcaaggggtggggcactgactgaactggaacccatcgagatagctgtgattgcctgtcaggcccttgcaaagggctgaggcccagctctgtctggtgggtgtgcagggcaccgaagggagatctttagcctccatcacctgccatcccaagcaagagtggacacctggggttcctagccgcattgaggtgggaccaggaatgtgtatgtataacatgtggagaaggaccatgtgtggggtggggagtgaagctcccacatgtggaatggaagccctttgcattggccaagggcagaggtgggagattgatggttcatttttccttggccctagcccttagctacagggaggcctagagagaggacacttggcaagtttaggatgggaaacaaggttaagcctggctttgctattcagacctgtgcagccctgattttggggactgggcccaaggagccatgagtcttaggcttgacactaggggccttacatggccaggtctcatatgggatttggagaaggcatttttcctaacactgatactacaagtcaccaatactcttgatgccttaagatgctagaaagccttggagagtggaggcagcagagatgggaatggaggtctgaagaagcttgctgctgttggggaatgtgtttgggaaagtcaagagtggtaggattggttggctgggcgcggtggctcacacctgtaatcccagcactttgggaggccgaggccggtggatcacttgaggtcagaagttcgagaccagcctgcccaaatggtgaaaccccatctctactaaaaatacggaaaaaaaaaaaaaaagagtgctaggattgggccagttaagagcaggggagacctggctgggcatggtggctcacacctgtaattctagcactttgggaggctgaggcgggtggatcatgaggtcaagagattaagaccatcctggcctacatggcgaaaccctgtctctactaaa

SEQ ID NO: 345522 - DNA, 1084 bp, Homo sapiens
cccacctcccccaggcccagccccagggccccctcaggacatttcagaacctccaggggggtcgccactgccatctccaccttccacagcacccccaccacctcccctgctgctggaacccccacctcctgagccaggggttctcttagctctactccaacaaactgtgtctttaaggatctgggcacttgtttcttgtggggggtgggaggtacacagcaggtgttgggcgacctgactcagacacagaggagtctttgatccccaaagaccaacgatgagaagcagtggcccaggaagaccgagagtgggcttctgtttcccaaagcgctggtgtgactgtggactgtttacacgtggggggtgggaggggaaggagggtagagagaaggaaccattaaggacctgggcgctgagtttctgctctctggtactatctgctttagcaagagttatttaaaacagttttacaagcacggcctactgagcaggttctgaaagcaaggggtggggcactgactgaactggaacccatcgagatagctgtgattgcctgtcaggcccttgcaaagggctgaggcccagctctgtctggtgggtgtgcagggcaccgaagggagatctttagcctccatcacctgccatcccaagcaagagtggacacctggggttcctagccgcattgaggtgggaccaggaatgtgtatgtataacatgtggagaaggaccatgtgtggggtggggagtgaagctcccacatgtggaatggaagccctttgcattggccaagggcagaggtgggagattgatggttcatttttccttggccctagcccttagctacagggaggcctagagagaggacacttggcaagtttaggatgggaaacaaggttaagcctggctttgctattcagacctgtgcagccctgattttggggactgggcccaaggagccggctctttgtgtccaccaaaaaaaaaaccaaaagttaagaattagctgggcttggcagcacacacctgcagtcaggaggctgacgtaagaggatcgcttgagcctcagaggtcaaggctgcagtca

SEQ ID NO: 345523 - DNA, 378 bp, Homo sapiens
ctgctcaggggcccatcggaaagccacctcctgagccaggggttctcttagctctactccaacaaactgtgtctttaaggatctgggcacttgtttcttgtggggggtgggaggtacacagcaggtgttgggcgacctgactcagacacagaggagtctttgatccccaaagaccaacgatgagaagcagtggcccaggaagaccgagagtgggcttctgtttcccaaagcgctggtgtgactgtggactgtttacacgtggggggtgggaggggaaggagggtagagagaaggaaccattaaggacctgggcgctgagtttctgctctctggtactatctgctttagcaagagttatttaaaacagttttacaagca

SEQ ID NO: 345524 - DNA, 890 bp, Homo sapiens
agcccatttcacagcctgaccctgacccccagactattctattccctaagtgagatgatttttaagatttcgtttgagcctgtggcctttggtttgggctgctaaagggtccttcggtccgcctgcttcttctcccttctctgcggcatcaagctggtcctggctgactctgcaaaatactttggtagaattttcaggaatggtaaatggtgtcatttagatgtcagctataatacagtgaatgcctagactgctgtcttaagaaggatcctgaggctgtgcgtggtggatcgtgcctataatcccagcacttcgggaggctgaggcgggtgatcacttgagctcaggaattcaagaccagcctgggcaacatggtgaaaccctgtctctacaaaaataaaaaataaaaaaaaaaaataaggatgctgagaccggttcctgcttcagcaagaatgaaggctttaaatcagggagtgggagtcgctgctctgggtgccaagtgttcaccattccccagaagctctgaccaggtccattctgtggttcagaagtatatgagttaaattacaataggaagttctttcagattttccattttaattgtccttccttaaaacgatcctccccagaacatgaggtttatctctactgggtcccagggagcccatgctcttctcaccatgggttgttcctaattggtcaaatatgattctcctttctagccaaatcctctgttgattttggatgtttttctgagctgctccctttgtcctttttggctttgagaagttatttgccagttatgatggcaaaccagggtctcagcttggactgcctgcttgtaaccctttcttcagcttggatgaggactccatccttgcaacgctgag

SEQ ID NO: 345525 - DNA, 599 bp, Homo sapiens
tgctgggattacaggcatgagccactgtacgtggctgggtttatatttttacaaagcaatttcagtaaatgctatgtacacttttacttatacagcccatcagcccccatccctcaggtcctggccattcctctacatacattcattcgcttttattccctaccctgtatgtctactgtaacaccgggagtcctggcccccatgcttctggctgcccctaagaatccctgtgttggtctctgtagtgttagttgtgtggccatctgctagaggaaccttcagtcctcagttctgcccgcaaaattcccctgcttggaaatcatcagaaattcccattgctaaacttgatgttttggctttcaaagcatccataatttaatttccaactatcatgttaaggctgttctctttcttattctctctttcactctcttttttaggatattccatgttctagtcaaaatgaactgttcaccctttcccacttttctagctttgtgcatttgctcacttcttccctcatctggaaagccccaatcgtgcccaccctccaagctcagcgacccatctcccttactcccagccccagctgacaatct

SEQ ID NO: 345526 - DNA, 485 bp, Homo sapiens
gtctcaaaaaaaaaaaaaaaaaaaaaaatcttgtggcaattccatattaatacccagagcttctcaaattgtttttatttgtatgcttttgtttatagctgcatagaattctattgtgtaccaaagtttatttaaccaatctgctttaggcaaatatttgggttatttccaaacctttagcactaaaaacaatgctcaatgaataattacacatggaaacatatacagatgaatctgtggaatacaattctagatatgagattgcagaatcaaaagacaaatgcatttataataatgataaatattgacatattttatagggatttgtcccatttttgcatttctgccagcaacatagaagagcgtcagaacagggcttttctgaatgggttcccactattaacaggagctgtgataatttatacattgacaaaaaaagaacaaaatcagtgtgatatattaaaaacagaatggttttctaatgc

SEQ ID NO: 345527 - DNA, 290 bp, Homo sapiens
aacacatgaaatttgcaggacacatttaaaccacagcacttagtgaatgactggagagtaagaggaggtaaaattgacaggtaggcagaggccaaatcacaaaaagccttgaaggccccggaagtgtttggattttactagaactgcaatgggaagcctctggagtttttaagaaggatagtggtaaaatttgtgtttttaaaaagattaccctggttggtgtgtagagaatggacagtggaagtatcaagagttgaaagtataggaggctatcccagtaatccatgcaa

SEQ ID NO: 345528 - DNA, 455 bp, Homo sapiens
tctgagtatattttgtattcttatacacttgactcgggtccagttgataactggcagagttttataacactgcaccgagaagagcccatgcaacatgtgtcataacagttcgttaaagaatagcatcaacaaaaaaattagttcttagaattttttattttccaactaatagttgtcactttctccatttatccaaagcataccaatctttcaaggtcatctgaagtcccactgtactactaagccttctggctgacttcagaccccattcatgtgagctttttgtatccaaaatgcctctacagcctcggtggcccaatatgatctgaattttataccatctgctcttcactcacaaggctctggctatactctcttgtattctttaaaaacccaaactcattcctcctctcaaggattttgcattcatttttcctttggagctatatattctt

SEQ ID NO: 345529 - DNA, 582 bp, Homo sapiens
aggttcacaagcaggtggttgagagtgcttacgaggtgatcaaactcaaaggctacacatcctgggccattggactctctgtggcagatttggcagaaagtataatgaagaatcttaggcgggtgcacccaatttccaccatgattggtggaataaaggatgatgtcttccttagcattccttgcatcttgggagagaatggaatctcagaccgtgtgaaggtgactctgactcctgaggaaggggcccatttgaagaacagtgcagatccactttgggggatacaaaaagagctgcaattttaaagtcttctgatgtcatactatttcactgtctaggctacaataggattttagttggaggttgtgcatattgtcctttttatctgatctgtgattaaagcagtgatgttaagatggattgggaaaaacatcaattcctaaggttagaaataggaatggtttgtaaaatcctacagtatattctgtaggtactatatcctgtaggtagctataacttgtagtaccattctgtaggctggatggtactaatcttgtgtagtcctaaactggtttgtgtgaa

SEQ ID NO: 345530 - DNA, 348 bp, Homo sapiens
ccttgcccaagaatgagcaagtcttctgagatccttggaggtcaaagatgttgggagcttcagagatctgcttcaccttcctatgaaatcgatctcaactttcacccccagcctacttccctgccacgtcccatgtcattctttttatctccctcccaaacccaagtctaaaaggaatagactgggaaaaaggaaaaaaaaatttcttatttttctctttgggggtttcacatcagtcccagatcattagctatgctcaggagaatgaagttttctcccctcaattcattttttttattttgagagtttttaattttttttaattaattacttattttttgagatgag

SEQ ID NO: 345531 - DNA, 215 bp, Homo sapiens
tttctgctaaaaatggcagttgtgtgagttttatttcttagaaaataactatattttatatttggtgaatatcttagttttgcatttaatttgctaagcagaatcaatgcaatcactatcatattctatagtttttcctaacagattgatagagtaaaatgtatggtttttctaatttttagcatttgtgtccaataaaatgactttatataatt

SEQ ID NO: 345532 - DNA, 763 bp, Homo sapiens
aatgtaggtcatgtgggttgttgtgtcaggtgagcctaatgtgatatgtgaaaactagaaactactttgaccagtctcccagacaaggcattagggagaaattttactgatttaaaataatcatgatagtcataaagaattggagaggcataaaattgtaactttttttttgcttttgacccagttattctaatagttttatgatttagaaagatctttaacatatctcatagatttaggccagacttgcctcgtatctgtgcagcgtatgaagccatgactgattgcctttgtttcaaacaaactgttagctttgcaatttgtctctgtgggatggacagctcgaaaaccatttctgtcatttccaggagaaagtgtcaagactggatagaatcgttgcagaacacaatcagttctctcttgggattaaagaattacaagactggatgacggatgcgattcacatgctggattcatactgccacccgacatccgacaaaagtgtgctggacagcaggacgctcaagctcgaggtgtgcatctttacacagaaatatctccaacctacagaatttgtttttctcaaaatttcccgtctccatccacctggggtgatgatgtcacattctctccatgataaatctcagatgctttgtgagtgcaacgctgtctgccttgggtgcacatgccagagaattcctgaatcatctgaccccggatgttttccaaaaaataaaataaaataaagcccgaatctgattac

SEQ ID NO: 345533 - DNA, 1899 bp, Homo sapiens
actcctgagctcaagctatctgctcacctcggccacccaaagtgctgggattacaggcgtgagccactgtgcccagcctgggtggactttgaatgtcaagtgaaggaccttggacttgctattaaaatattttcttgtcctggacactatctaaaaccttgcagaatctaaagatccaaatgaaggactttgaagtaagtgctgagcctatccaggactggctgagtaaaactgagaagatggtccatgaaagcagcaatcgcctctatgatctgccagcaaagaggagggagcagcagaagctccaggtgatgagcccgcctccccgtagccccatctgacctagtctttgtccgtcctctgtcgaccttacagatgcatgctcagcacccttgagttagactgtgctgccgtgagacatagtgtgtttttccccatttctggtggattttatgttttctgactttccttggaagtatgatttgtttccttccatgatttgtgctccacggtgtgtagattggagataataaagcctccagggtacacggactgcctgccagtgttgatttccatgttctctgggccaaagcttcgtccgcgatgtgcttttccccagcctctgaatagtaacttgcttgtgcttttcagtctgtccttgaggaaatacactgctacgagcctcagctcaacaggctgaaagagaaagctcagcagctgtgggaaggacaagctgccagcaagagctttaggcacagagtgtcgcagctgtcttctcagtatctagcgctaagcaatttaacaaaggagaaagtgtcaagactggatagaatcgttgcagaacacaatcagttctctcttgggattaaagaattacaagactggatgacggatgcgattcacatgctggattcatactgccacccgacatccgacaaaagtgtgctggacagcaggacgctcaagctcgaggctctattatcagtcaaacaggaaaaagagattcagatgaaaatgatagtgaccaggggagaatctgtccttcagaatacttctccagaaggcattcccactattcagcagcagctgcagagtgtgaaggatatgtgggcatcccttttgtctgcagggattcgttgtaaaagccaactcgaaggagctctctccaagtggacaagttatcaggatggcgttcgacagttctccggttggatggatagtatggaagccaacctgaatgaatcagaaaggcagcatgcggagctgcgggataaaacaacgatgctcggaaaagccaagttattaaatgaagaagtgctgagttacagcagcttgctggagaccatcgaagtcaaaggggctggcatgacagaacactatgtcacccagctagaactccaggatctacaggaacgatacagagccatccaagagagggccaaggaagccgtaaccaagtctgaaaaacttgtccgcctgcaccaagagtatcagagagacctaaaggcatttgaagtttggttggggcaagaacaagaaaagctcgaccagtattcagttcttgaaggtgatgcccacactcatgagacaacattgcgtgatcttcaggagctacaggtacactgtgcagaggggcaggccctgttgaactcagtgctgcacaccagagaggatgtgatcccatcaggtatcccacaggcagaggaccgggctttagagtctctccggcaagactggcaggcttaccagcacaggctgtccgagactcgaactcagttcaataacgtggtgaacaaattgaggctaatggagcaaaagtttcagcaagtagatgaatggctcaaaacagcagaggagaaagttagtcccaggaccagacgtcagtctaacagggcaacc

SEQ ID NO: 345534 - DNA, 1202 bp, Homo sapiens
actcctgagctcaagctatctgctcacctcggccacccaaagtgctgggattacaggcgtgagccactgtgcccagcctgggtggactttgaatgtcaagtgaaggaccttggacttgctattaaaatattttcttgtcctggacactatctaaaaccttgcagaatctaaagatccaaatgaaggactttgaagtaagtgctgagcctatccaggactggctgagtaaaactgagaagatggtccatgaaagcagcaatcgcctctatgatctgccagcaaagaggagggagcagcagaagctccaggtgatgagcccgcctccccgtagccccatctgacctagtctttgtccgtcctctgtcgaccttacagatgcatgctcagcacccttgagttagactgtgctgccgtgagacatagtgtgtttttccccatttctggtggattttatgttttctgactttccttggaagtatgatttgtttccttccatgatttgtgctccacggtgtgtagattggagataataaagcctccagggtacacggactgcctgccagtgttgatttccatgttctctgggccaaagcttcgtccgcgatgtgcttttccccagcctctgaatagtaacttgcttgtgcttttcagtctgtccttgaggaaatacactgctacgagcctcagctcaacaggctgaaagagaaagctcagcagctgtgggaaggacaagctgccagcaagagctttaggcacagagtgtcgcagctgtcttctcagtatctagcgctaagcaatttaacaaaggagaaagtgtcaagactggatagaatcgttgcagaacacaatcagttctctcttgggattaaagaattacaagactggatgacggatgcgattcacatgctggattcatactgccacccgacatccgacaaaagtgtgctggacagcaggacgctcaagctcgaggtgtgcatctttacacagaaatatctccaacctacagaatttgtttttctcaaaatttcccgtctccatccacctggggtgatgatgtcacattctctccatgataaatctcagatgctttgtgagtgcaacgctgtctgccttgggtgcacatgccagagaattcctgaatcatctgaccccggatgttttccaaaaaataaaataaaataaagcccgaatctgattac

SEQ ID NO: 345535 - DNA, 1433 bp, Homo sapiens
cagacttcgatcgcggagaatctgtccttcaaatacttctccagaaggcattcccactattcagtcagcagctgcagagtgtgaatggatatgtgggcatcccttttgtctgcagggattcgttgtaaaagccaactcgaaggagctctctccaagtggacaagttatcaggatggagttcgacagttctccggtaggtatggatagtatggaagccaacctgaatgaatcataagaggcagcatgcggagctgcgggataaaactgagaagatggtccatgaaagcagcaatcgcctctatgatctgccagcaaagaggagggagcagcagaagctccaggagaaagtgtcaagactggatagaatcgttgcagaacacaatcagttctctcttgggattaaagaattacaagactggatgacggatgcgattcacatgctggattcatactgccacccgacatccgacaaaagtgtgctggacagcaggacgctcaagctcgaggctctattatcagtcaaacaggaaaaagagattcagatgaaaatgatagtgaccaggggagaatctgtccttcagaatacttctccagaaggcattcccactattcagcagcagctgcagagtgtgaaggatatgtgggcatcccttttgtctgcagggattcgttgtaaaagccaactcgaaggagctctctccaagtggacaagttatcaggatggcgttcgacagttctccggttggatggatagtatggaagccaacctgaatgaatcagaaaggcagcatgcggagctgcgggataaaacaacgatgctcggaaaagccaagttattaaatgaagaagtgctgagttacagcagcttgctggagaccatcgaagtcaaaggggctggcatgacagaacactatgtcacccagctagaactccaggatctacaggaacgatacagagccatccaagagagggccaaggaagccgtaaccaagtctgaaaaacttgtccgcctgcaccaagagtatcagagagacctaaaggcatttgaagtttggttggggcaagaacaagaaaagctcgaccagtattcagttcttgaaggtgatgcccacactcatgagacaacattgcgtgatcttcaggagctacaggtacactgtgcagaggggcaggccctgttgaactcagtgctgcacaccagagaggatgtgatcccatcaggtatcccacaggcagaggaccgggctttagagtctctccggcaagactggcaggcttaccagcacaggctgtccgagactcgaactcagttcaataacgtggtgaacaaattgaggctaatggagcaaaagtttcagcaagtagatgaatggctcaaaacagcagaggagaaagttagtcccaggaccagacgtcagtctaacagggcaacc

SEQ ID NO: 345536 - DNA, 447 bp, Homo sapiens
gctagttccatgtttctgcatattggcctgggtttaaatgttccttgcttcctgaggctgcccttcagacctggactcagtgtccttaagccctgggcagcctgctcactcccaagcaagcttcttcctgatctcttgaccccttgcttactggagtggatggagcagacacaatgacattttagactcctaaggattctcaatgtggatttattgtcctttcaaatccctttcagccaactcgaaggagctctctccaagtggacaagttatcaggatggcgttcgacagttctccggttggatggatagtatggaagccaacctgaatgaatcagaaaggcagcatgcggagctgcgggataaaacaacgatgctcggaaaagccaaggtgagagctggatttcagattccatgtgttttctcacaggcttctttagaatgccac

SEQ ID NO: 345537 - DNA, 1460 bp, Homo sapiens
aatgtaggtcatgtgggttgttgtgtcaggtgagcctaatgtgatatgtgaaaactagaaactactttgaccagtctcccagacaaggcattagggagaaattttactgatttaaaataatcatgatagtcataaagaattggagaggcataaaattgtaactttttttttgcttttgacccagttattctaatagttttatgatttagaaagatctttaacatatctcatagatttaggccagacttgcctcgtatctgtgcagcgtatgaagccatgactgattgcctttgtttcaaacaaactgttagctttgcaatttgtctctgtgggatggacagctcgaaaaccatttctgtcatttccaggagaaagtgtcaagactggatagaatcgttgcagaacacaatcagttctctcttgggattaaagaattacaagactggatgacggatgcgattcacatgctggattcatactgccacccgacatccgacaaaagtgtgctggacagcaggacgctcaagctcgaggctctattatcagtcaaacaggaaaaagagattcagatgaaaatgatagtgaccaggggagaatctgtccttcagaatacttctccagaaggcattcccactattcagcagcagctgcagagtgtgaaggatatgtgggcatcccttttgtctgcagggattcgttgtaaaagccaactcgaaggagctctctccaagtggacaagttatcaggatggcgttcgacagttctccggttggatggatagtatggaagccaacctgaatgaatcagaaaggcagcatgcggagctgcgggataaaacaacgatgctcggaaaagccaagttattaaatgaagaagtgctgagttacagcagcttgctggagaccatcgaagtcaaaggggctggcatgacagaacactatgtcacccagctagaactccaggatctacaggaacgatacagagccatccaagagagggccaaggaagccgtaaccaagtctgaaaaacttgtccgcctgcaccaagagtatcagagagacctaaaggcatttgaagtttggttggggcaagaacaagaaaagctcgaccagtattcagttcttgaaggtgatgcccacactcatgagacaacattgcgtgatcttcaggagctacaggtacactgtgcagaggggcaggccctgttgaactcagtgctgcacaccagagaggatgtgatcccatcaggtatcccacaggcagaggaccgggctttagagtctctccggcaagactggcaggcttaccagcacaggctgtccgagactcgaactcagttcaataacgtggtgaacaaattgaggctaatggagcaaaagtttcagcaagtagatgaatggctcaaaacagcagaggagaaagttagtcccaggaccagacgtcagtctaacagggcaacc

SEQ ID NO: 345538 - DNA, 403 bp, Homo sapiens
tgctccacttctccatcgcattgcagcatccacacacatttacctctggagacaggagctccttggaagctgggaggtcactcggtggtcaaggggtagatgatcttagttttacagtgctgcgctgtctcccaggctgaatgacgctgaagccaagcaaattcgggcagtctctggacctttctaatggaggtgtcccataaccatgttccatcctagttccctggcataggcttgttgaagctgcagaaaatgtcagggatttattagtgatttaccgactccttcatacttagtgttcaggaaaatttattcatgtaatacttcttcaaccaaagaggaaatatcaattagagctttgtaagtttcttttccacttcctattttggctatcaagctatag

SEQ ID NO: 345539 - DNA, 453 bp, Homo sapiens
acaggagggtgaggtcagcaccttcaattcaacagaacctccttagagatgaaccccatcgaccaccccacagggcacagagccagtttcggacttctcagcgctccgcctctcttaggtctcctctgaatcagcagcaaccctgggtgggaggggcagacttttgttattccaaattaaatgatgagaaagctgggcaaaagggaatgaatcgatttgcccaaggtcttaagtgctcctgcctagaaggcaggttttttaaagagagaagatgactttttaaaataattgatgtttttttaaaatgtaagaaaagtaaacaaatatatcaggtcataaataataagactcatttaagtccatcaatcttccccagattcatctaaaaatcaatacgatcatgattcaagatccaaagggctgattaagcccctaggcatatagttgtactcc

SEQ ID NO: 345540 - DNA, 416 bp, Homo sapiens
aaaaaaaaaaaattagctgggttatggcagtggcacactagtagtcccagctactcggaaggctgaggcaggagaattgctcgaacccaggagtggaggttgcagtaagccaagatcatgccattgcactccagcctgggcgacagagcaagactccatctcaaaaaagaaaaaaaaagagactacctcatacttcatacacatacaaactctggatggattaaaggtctaaatagaaaaaacaaagttttaaagctgttagaagaaaatacagatggatatctttatgacctcaggttagagaagaatttcttaaagatgaccctaaattatgaaccaaatgatgatgaaaactaattatggaaaactaataatttgattatctcaaaattaaaaactttggaatggcaatacac

SEQ ID NO: 345541 - DNA, 494 bp, Homo sapiens
tggctcagccttgaaccatgcatgaaaaggacagataccaagcagcctggctaagaactaaagagctgaactgagatttgattgctgctcaagaaacaggacttaaagtgaatccagtcagcttattattgcccgtgaagacaaagtaatttacagtctcctgaggaatatgagggaatctagaacctcctaagcataacactcaacaatgtccaggatgcaggccaaaattatttaacatatgaagaaccaggaaaatgcgacctattcgaaaatgtgaaaaagatagtcaatagaaaccaatctgtagatgactgagatgttggaattagcagataagaattttacgactgcttgtaactgtggtaacaacataatgggaaatatgctcataatgaatgaaaaaaagaaaaaatctcatatggttaataagaactataaataagaaccaagtagaaattctagaatggaagaacacaatagccaatataaaa

SEQ ID NO: 345542 - DNA, 415 bp, Homo sapiens
attaatactccctgcctatattttccaagtcgcaccgaagattaacattgctcagaaagcttcacatgtgagataaatgcactcaaagattcctcacaagtagctctttggagcttcagatgtgaaatggatcattcctcaatctgtaatagacccttctgtgaagctcttcaatcaaaccagagaattcaagagtttccaacacctaagagtggtatttggcaaatggtgggccaaaggaataaagaaggcatgcaaaactcttgacagaagacattcagaaattgatttgatatcagatacaaggagaaaatatgccagtaagaaaatgcatttttcaagattaaattcggcatttgttacttaatagcatttgtcatattccaatttttcatatgtagtaaattcatttcaa

SEQ ID NO: 345543 - DNA, 412 bp, Homo sapiens
ataaaatcttttcattataattcttcaagacaggaaaaaattaaaaccttcaaaagcttcacatgtgagataaatgcactcaaagattcctcacaagtagctctttggagcttcagatgtgaaatggatcattcctcaatctgtaatagacccttctgtgaagctcttcaatcaaaccagagaattcaagagtttccaacacctaagagtggtatttggcaaatggtgggccaaaggaataaagaaggcatgcaaaactcttgacagaagacattcagaaattgatttgatatcagatacaaggagaaaatatgccagtaagaaaatgcatttttcaagattaaattcggcatttgttacttaatagcatttgtcatattccaatttttcatatgtagtaaattcatttcaa

SEQ ID NO: 345544 - DNA, 1058 bp, Homo sapiens
aaaaacagattaccaaaatacagtttttgacttaattactggggcttctaggtcttaatggatgagatttctttgagaatggaaaacaataaaccgttgtgttgacatgcctgtgagctttttaaatgcttggggaaatagtttcaaattcactgaacattgctaaaaaatttcacttacaaaagaaatctcatttccttaacgtttctttttaaaagtcaatttaaataagcaacttagtagcctttggaacttgggtcatcagtcatccagtttctgttctcagctcctggagaaagaattttacaaaggatgggaaacttcaaataagtgcaattcattttgggctgacccagtgccctggataatgtgttttgttcggttcgtgcttcagacatttcttgcaggatatcgtagtttggagatttcttcctcccgtaactgattttacatacctaggatcaccactctacggcagttgtgaacatattaagaggaagaaaacaagtgggctattgaattgcagtttcctcatctacatgtgcgtgaccttttttccttgtaagaaggaaaaaaacaaaacggttcttttggagagggccagggttctctaagtatgtcagggatcaaaagtgggaaactgggaaaatgcaacttcaacgtgttttgtcttttaacggaacttatgcttgtaaaacacatcagaagtacagtgtttggttctgcaagtcatttctgttgttgttttttccttgttacgtggaggccggggggactgggggctggaggaggtgttccctccaacatgactgggcgtgtaacacgtttgcatcaacttttcacagtcagacatgtgctttcgaacaaaggagcagtggagacaggcagagatgggggcttgacacagtttacagattttgtgcttcaacagtactttacaaatgacttgctcaattttaacgtccatcaccacaagagacattggagtaaaatgagaaaattggagctacttgaaccaatcttttttggggagtgggggggaggggaaccattaattt

SEQ ID NO: 345545 - DNA, 666 bp, Homo sapiens
gactcttttacattggaagactaaatctccccaaacaggtgtcattctggagcaaattgaaagagtttgagcttggattatagtgaggattcctaagatcttctggaccacgtgtctttctcttgaaaagccttcagaccgaagtgtgttctctttttatatcctattctagaccatagtcctaccatgcctaaaagtgacctgctttggagatacggctgatcagtacaggtatatggaagaaattctctgtgaattttgtaattcacaaattttaagaagttgctacaattgtacaggatgatcatgggaagctatgtatctcagtttgtctacccaagatgggcatcctgggaggatgacaggtgaacttgtcacatacatatcccaattgggaaaaggaataaggaattatctgaatgattaggttttgaagtttaagacccctaggaattcaaaatattcgagaagaaaattctgacaatgatcaataatttatttagttaacaacactgtgggcagctacaatatggtttcagctacaatatggcagctacagtatttcaattgattcccatgctacctatcaaaataaaataaaatttgaaagtctttcttatatttgcatgtctgatattttcatagagagtgccattgtgtgagaat

SEQ ID NO: 345546 - DNA, 7566 bp, Homo sapiens
ctccttctgcagcgcggccggcgggcgctcctcttcccgggaccagcgaggcggcggccgctgctccagcgtcccccagccgcgggcccccgacgcgctgcagccggcagcccaccgccgccttcttggcgcgaccccaacccagccccacaggagactctctgaagaccagcaggaaagcagtgagcccttacaggtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaa

SEQ ID NO: 345547 - DNA, 7540 bp, Homo sapiens
gaattccggctctcaaattttctatagaatcaagatagaacctttagatgtctcaccacgaaactagcaactggaatgaagatagaaacaagtggttataactcagacaaactaatttgtcgagggtttattggaacacctgccccaccggtttgcgacagcaagtttctcctgtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttctgggctctatgtttcctttaccccgaattctgtttgccatggcccgggatggcttactgtttagatttcttgccagagtgagtaagaggcagtcaccagttgctgccacgttgactgcaggggtcatttctgctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaa

SEQ ID NO: 345548 - DNA, 7512 bp, Homo sapiens
ctccttctgcagcgcggccggcgggcgctcctcttcccgggaccagcgaggcggcggccgctgctccagcgtcccccagccgcgggcccccgacgcgctgcagccggcagcccaccgccgccttcttggcgcgaccccaacccagccccacaggagactctctgaagaccagcaggaaagcagtgagcccttacaggtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagctaatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaa

SEQ ID NO: 345549 - DNA, 7521 bp, Homo sapiens
ctccttctgcagcgcggccggcgggcgctcctcttcccgggaccagcgaggcggcggccgctgctccagcgtcccccagccgcgggcccccgacgcgctgcagccggcagcccaccgccgccttcttggcgcgaccccaacccagccccacaggagactctctgaagaccagcaggaaagcagtgagcccttacaggtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaa

SEQ ID NO: 345550 - DNA, 7594 bp, Homo sapiens
ctccttctgcagcgcggccggcgggcgctcctcttcccgggaccagcgaggcggcggccgctgctccagcgtcccccagccgcgggcccccgacgcgctgcagccggcagcccaccgccgccttcttggcgcgaccccaacccagccccacaggagactctctgaagaccagcaggaaagcagtgagcccttacaggtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaacaactatgacaataattagatcagaaactactaaccccaacgctccctgcagcctgccttacaggctagctcgtccacacacaaacactcccacacggcccagcgcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaa

SEQ ID NO: 345551 - DNA, 7520 bp, Homo sapiens
ctccttctgcagcgcggccggcgggcgctcctcttcccgggaccagcgaggcggcggccgctgctccagcgtcccccagccgcgggcccccgacgcgctgcagccggcagcccaccgccgccttcttggcgcgaccccaacccagccccagtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaa

SEQ ID NO: 345552 - DNA, 7712 bp, Homo sapiens
ctccttctgcagcgcggccggcgggcgctcctcttcccgggaccagcgaggcggcggccgctgctccagcgtcccccagccgcgggcccccgacgcgctgcagccggcagcccaccgccgccttcttggcgcgaccccaacccagccccacaggagactctctgaagaccagcaggaaagcagtgagcccttacagtcccaaaacagaaagagcagatgtctcaccacgaaactagcaactggaatgaagatagaaacaagtggttataactcagacaaactaatttgtcgagggtttattggaacacctgccccaccggtttgcgacagcaagtttctcctgtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaa

SEQ ID NO: 345553 - DNA, 7519 bp, Homo sapiens
ctccttctgcagcgcggccggcgggcgctcctcttcccgggaccagcgaggcggcggccgctgctccagcgtcccccagccgcgggcccccgacgcgctgcagccggcagcccaccgccgccttcttggcgcgaccccaacccagccccacaggagactctctgaagaccagcaggaaagcagtgagcccttacaggtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaa

SEQ ID NO: 345554 - DNA, 7512 bp, Homo sapiens
ctccttctgcagcgcggccggcgggcgctcctcttcccgggaccagcgaggcggcggccgctgctccagcgtcccccagccgcgggcccccgacgcgctgcagccggcagcccaccgccgccttcttggcgcgaccccaacccagccccacaggagactctctgaagaccagcaggaaagcagtgagcccttacaggtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctaatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaa

SEQ ID NO: 345555 - DNA, 6157 bp, Homo sapiens
actctagaggtccccgcatgtagtgaggacacagatggcacgtgggcagataatgccagtgagtaacactaggaggggcggttggttctaaggaggggagagtaatgagtaaataagcaatggttcttaaatccctgcaactggacatctctctcctcagtgaaaaagaagaaagggcaaggcgaagactctttgtatttagccaagtagatgtgtacagaagtcagtgttttatcagaatatgctgttttgcaccaagcaatctgggtggagcacagtgtgctgactctgttatctacacatccccctgcagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaa

SEQ ID NO: 345556 - DNA, 6109 bp, Homo sapiens
tttcacttgggccaaatgtctatttgagaataaagacatagatgtttgtttggaaataggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaa

SEQ ID NO: 345557 - DNA, 5109 bp, Homo sapiens
aaaacagtgggcagtgtattatgtatctatgtatatgcttgggaacatgagtgtacatactattgatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaa

SEQ ID NO: 345558 - DNA, 7619 bp, Homo sapiens
ctccttctgcagcgcggccggcgggcgctcctcttcccgggaccagcgaggcggcggccgctgctccagcgtcccccagccgcgggcccccgacgcgctgcagccggcagcccaccgccgccttcttggcgcgaccccaacccagccccacaggagactctctgaagaccagcaggaaagcagtgagcccttacaggtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaatatgctttctgatgtggtgtatttttaaaataaattttaatatgtaataatat

SEQ ID NO: 345559 - DNA, 7649 bp, Homo sapiens
  misc_feature (7408)..(7408): n is a, c, g, or t
  misc_feature (7443)..(7444): n is a, c, g, or t
  misc_feature (7446)..(7446): n is a, c, g, or t
  misc_feature (7538)..(7538): n is a, c, g, or t
  misc_feature (7577)..(7577): n is a, c, g, or t
  misc_feature (7580)..(7580): n is a, c, g, or t
  misc_feature (7582)..(7583): n is a, c, g, or t
  misc_feature (7585)..(7585): n is a, c, g, or t
  misc_feature (7615)..(7615): n is a, c, g, or t
  misc_feature (7619)..(7619): n is a, c, g, or t
ctccttctgcagcgcggccggcgggcgctcctcttcccgggaccagcgaggcggcggccgctgctccagcgtcccccagccgcgggcccccgacgcgctgcagccggcagcccaccgccgccttcttggcgcgaccccaacccagccccacaggagactctctgaagaccagcaggaaagcagtgagcccttacaggtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtacccttgnttaccccactcatttcttcacatacacgttttccnntnccctaataatataaatgttttaagtgatcatcagtgttccttttcaccctccagttgccttcttttctagaataaataataaataatacctntttcttttcctctgtaaatccagtactgttcctatatcnaangnncngttcacatccatgtcaaatcaacccccccncccntctcccgtaatttcccaataccctcaacat

SEQ ID NO: 345560 - DNA, 7013 bp, Homo sapiens
ctccttctgcagcgcggccggcgggcgctcctcttcccgggaccagcgaggcggcggccgctgctccagcgtcccccagccgcgggcccccgacgcgctgcagccggcagcccaccgccgccttcttggcgcgaccccaacccagccccacaggagactctctgaagaccagcaggaaagcagtgagcccttacaggtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaataggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaatatgctttctgatgtggtgtatttttaaaataaattttaatatgtaataatat

SEQ ID NO: 345561 - DNA, 5974 bp, Homo sapiens
  misc_feature (5922)..(5922): n is a, c, g, or t
ctccttctgcagcgcggccggcgggcgctcctcttcccgggaccagcgaggcggcggccgctgctccagcgtcccccagccgcgggcccccgacgcgctgcagccggcagcccaccgccgccttcttggcgcgaccccaacccagccccacaggagactctctgaagaccagcaggaaagcagtgagcccttacaggtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctggaggaagagattatgggcttctgaaaaaaaggaaatcaacaaatccttctnaattagggaatctgcatgcacaagtacaggaaaaggacatattccacaaaaa

SEQ ID NO: 345562 - DNA, 1336 bp, Homo sapiens
gacatcgtaaaagataaatcccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaa

SEQ ID NO: 345563 - DNA, 899 bp, Homo sapiens
acttcggttctgattgagaaccaatctgtatgtgtgttttttggtttgaaaatcatatgttgaaaacacgttaatcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaa

SEQ ID NO: 345564 - DNA, 2822 bp, Homo sapiens
ctccttctgcagcgcggccggcgggcgctcctcttcccgggaccagcgaggcggcggccgctgctccagcgtcccccagccgcgggcccccgacgcgctgcagccggcagcccaccgccgccttcttggcgcgaccccaacccagccccacaggagactctctgaagaccagcaggaaagcagtgagcccttacaggtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaggtccaactcatagggtataacgcgtatcaggtagacctgtgagcaagacaggg

SEQ ID NO: 345565 - DNA, 426 bp, Homo sapiens
cggccgctgctccagcgtcccccagccgcgggcccccgacgcgctgcagccggcagcccaccgccgccttcttggcgcgaccccaacccagccccagtaagttgctaggtctccagccccgccgagagtccgcgggcgaggggcagcccggacgctggggccggcggggaaggagcggggcgagggcgccctggggccggcggggaactagagggtcgagggctcccggggacgagtccagctgcgcgcagctgccctgaggccgcgctccagcgagtcttcgtcagggagtcggggccgtgggctggggctgaagccgtggaccttcgtcctcggggctgcgccccggaatgcgcctcgcctcgtccggtccctgtgcagccggctctgcccggggacttcggggaccgctggaactgggagagg

SEQ ID NO: 345566 - DNA, 7297 bp, Homo sapiens
ctccttctgcagcgcggccggcgggcgctcctcttcccgggaccagcgaggcggcggccgctgctccagcgtcccccagccgcgggcccccgacgcgctgcagccggcagcccaccgccgccttcttggcgcgaccccaacccagccccacaggagactctctgaagaccagcaggaaagcagtgagcccttacaggtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaa

SEQ ID NO: 345567 - DNA, 6960 bp, Homo sapiens
ctccttctgcagcgcggccggcgggcgctcctcttcccgggaccagcgaggcggcggccgctgctccagcgtcccccagccgcgggcccccgacgcgctgcagccggcagcccaccgccgccttcttggcgcgaccccaacccagccccacaggagactctctgaagaccagcaggaaagcagtgagcccttacaggtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaataggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaa

SEQ ID NO: 345568 - DNA, 6700 bp, Homo sapiens
ctccttctgcagcgcggccggcgggcgctcctcttcccgggaccagcgaggcggcggccgctgctccagcgtcccccagccgcgggcccccgacgcgctgcagccggcagcccaccgccgccttcttggcgcgaccccaacccagccccacaggagactctctgaagaccagcaggaaagcagtgagcccttacaggtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaattcagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagatgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttactttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaa

SEQ ID NO: 345569 - DNA, 467 bp, Homo sapiens
gttagtggcaccaccacattctgtagcacagggtgagagagtaaagttttaattttatgtatatcatcttcaaagagctaataaacacaaccaccttccaaggatatagtctgagaaaagtcaccagaaggagagttttctgtcaaagtgactttccaatgtgtttgttctctttcttagagagccaccttctgaaaacggaacaagtatctatggggctggtggctttatgccttatggctttacgggaacgttggctggtgctgcaacttgcttttatgcctttgtgggatttgactgcattgcaacaactggtaagagcagtgtcttggctcagtgtagaaggagtgttccttgttgtgcacgagtacccgtgtgtggtagcagagggtccaggaaagagagagggatttcgggtaagaagggcactagttccaggcccagctgtgacacgtgctgctgatgat

SEQ ID NO: 345570 - DNA, 696 bp, Homo sapiens
aggactggccgctaaataacttcggtattgagagctgtgtgagcctcaaagggagggcccagaccagctggagtctctacccccagacaggataaagggcaggacttggggtcataggaggaggcggctaacatgaaaacaacttaggttggagagaaggaggggccaatccaatctgcaccctccctgtgtctgtcccgagtaggtgctgtccccctctcccttcctttgcccaccgattggagggacactctggaaaactcagttgaagaaagcggagagtctgcgtgtacacagtgcaatgatgtcagttaatgcactagtgagggcatgtgttgttcacggtacacagaagaaggaaccaccagcccttgggacacttaggcattggtgtagacaagggaacatttgagtcctggacgatggataggtccacggagcggagggaggagaaaaggattccagtcttagcgatcagcatcagcaaaggctccgaggtgccagaggcatagtgagttctccgatccctggctggtggagggaagctgggaagggcctggctgtccagggtggtgggaggaggctagagtagccagaccagatattttgggttgtctctgatgggcagtggggtgtgggggggaggtagataggtatttaggatggaattctgctagacaggaaaatatagttcag

SEQ ID NO: 345571 - DNA, 739 bp, Homo sapiens
aggactggccgctaaataacttcggtattgagagctgtgtgagcctcaaagggagggcccagaccagctggagtctctacccccagacaggataaagggcaggacttggggtcataggaggaggcggctaacatgaaaacaacttaggttggagagaaggaggggccaatccaatctgcaccctccctgtgtctgtcccgagtaggtgctgtccccctctcccttcctttgcccaccgattggagggacactctggaaaactcagttgaagaaagcggagagtctgcgtgtacacagtgcaatgatgtcagttaatgcactagtgagggcatgtgttgttcacggtacacagaagaaggaaccaccagcccttgggacacttaggcattggtgtagacaagggaacatttgagtcctggacgatggataggtccacggagcggagggaggagaaaaggattccagtcttagcgatcagcatcagcaaaggctccgaggtgccagaggcatagtgagttctccgatccctggctggtggagggaagctgggaagggcctggctgtccagggtggtgggaggaggctagaggagccaggtgggtcagcagagagacagtcacattaggagttagggcttcagtagggagacaggtgggtctcaggtgatgtcaagagatcttggtcagagctaggcctgaagaagattctggtatctctgctcaggaatcaggggaccagg

SEQ ID NO: 345572 - DNA, 335 bp, Homo sapiens
gatggaattctgctagacaggaaaatatagttcagttcctcatagttcaggctggagcaagtaagattccagttttaccactgaatctctgagcctgtctcctcatctgtaaaatgggaacagcaatcctagcccagagggttgtcaaagtcactgtgctatcgggcctggcagaatgggagtgagaggggctcagagggactgttacaggacatgaggtgacgatggtggggtggcaaggcaggagctgatggagactcactgagaagtggagaagcaagattcatcacatacgggacataaagggagatggaggggcagggggtagtcctggt

SEQ ID NO: 345573 - DNA, 775 bp, Homo sapiens
gtaaatagtgactgtttgttccagcaattttttggtggtgaagtaaccatcaagtgattcaggttcctcttggaaccctccaagaaaaacttcagggtcctagtgtaatacatctgtccccatctctcactggcgtatatatttaactggactcactctcccaccctcagctaatgctacaatcctggagtcacctcttgactcatctttcccattgccaccacaatccattctaatatgtcagaaaatctgtcagttttaatctacgaaatctcttaaaatatttccgtctaaccattccttgttttccttctatttctatagccacccttctggttcacaaaccttttacttcttgcctcaactagtgtaatagcttcctaacccatttctctctatttcagacagatggcaaggttattttccttaaaaagactcttattatgttgttccttagctcaaaatccttcaatggctgaactttcactgcctgaaagataaatcccaagattttagccatgcattcaagagcagctataaccataatgactccagccttcacacttccagcttcaccttccaaaccacctccatattccagcaaattagcctacttactgggtcctagtcacatcttaccacttcctaccctcccagttttatttataccaagcctcctcctgaaatttctcttcctttctttctacctacccaagacataccacgtgcttcaataaccagtcccttcctcctacaaacactacaacctggaaag

SEQ ID NO: 345574 - DNA, 505 bp, Homo sapiens
cagtactgttttctacagaaactgggggaaatactgagcacagaagaataaccaaagtgcttcccaccaataacttctgtgaaactacgttctctgaattcttctccaaattcttttctgattttgtaagtaatgatgttacaactaatttttttgctcatatattattaatattttctagcattaacaagacataggtaacagcattcattagctcagagtttttaagggttttgtttgcttgcttgctctgtttttttttgttgttttttggttttggagacggagtctccctccgtcgcccaggctagagtgcaggggcgcgatctgggctcactggaagcttcgcctccggggttcaagcgattctccggcctcagcctcccgagcagctaggactacaggcgcccgctaccaggcccggctaatttctggcatttttagtagagacgggatttcaccgtatgggccaggctggtctagaactcctgacctcgtgatccgc

SEQ ID NO: 345575 - DNA, 314 bp, Homo sapiens
cagtactgttttctacagaaactgggggaaatactgagcacagaagaataaccaaagtgcttcccaccaataacttctgtgaaactacgttctctgaattcttctccaaattcttttctgattttgtaagtaatgatgttacaactaatttttttgctcatatattattaatattttctagcattaacaagacataggtaacagcattcattagctcagagtttttaagggttttgtttgcttgcttgctctgtttttttttgttgtttttttatgccagaaaaaaaattaaagtcatctactttaaagttata

SEQ ID NO: 345576 - DNA, 160 bp, Homo sapiens
gtacgatttgatagtgttggtggcctgtctaatcatatagcagctctaaaagagatggtggtgtttccattactttatccagaagtctttgaaaaatttaaaattcaacccccaagagtgtggttgttttatgggccacctggaactggtaatactctgg

SEQ ID NO: 345577 - DNA, 379 bp, Homo sapiens
tgcactccagcctcagcggcagagtaaaactcagtctcaaaaaaaaaaaaacagaaagaaaaagaaaaaatcaaggtaaaaggagaagcttctgccaaccaagaggcagtagacaagttcccagatgctattaagaaaatcattagcagccggacgcagtggctcatgcctgtaatcccaggcatgcctcccactttgggaggcagaggcatgtaaatcatctgaggtcaggagttcaagagcagcctggcaaacatggtgaaaccccgcttctactaaaaatacaaaaattagcagaccctggtggcccggaggttgcagtgaggcgagatcatgccattgcactccagcctgggctacaagagcaagatgccatctc

SEQ ID NO: 345578 - DNA, 403 bp, Homo sapiens
tggggtcttactatagtaatgttaatggaacaaggcaaggggagggcgggatggccgtcatctcatgagcctcaccttgcaggatgtgcagcaggaagaagctgcgtcttgccgtttgaccatgcgagcatctagcgtgatcagcactgtgctcactgccatcatcaatgctaacagaaacgtgcagacaacacaaaacctcagaactcccatctcaatcaactgctcggaaacttcaatctgagagtaaactgtcatgtttttcccactctaaaacaggatgactaatgacagaggaacctcaacacaatccatggggctcaagccagatccctctcaacagagcacaaaagccacccagtcccaaaaaatgtgagccgacgccgggcccctcaacggattc

SEQ ID NO: 345579 - DNA, 798 bp, Homo sapiens
tgggccaaagatatgaagtttacaaaagaggaaaccccaagacaaacccatcataggaagagccactcaaatctcgcaatcagagaaaagcaaatgaaaaacaagatgtcaccttatacacatgagactggcagcggttgggaggctggacgagtcccagtgtggcaaggacggggagcctcctgtccaggtggtggaagatgcccggtgctgccagtcagggtcacagaaccagaaccatcaatgccacttctggatgtacaccctaaagaaaccctcgtgcagacccatcaggggacatgtttggatgtcaccattcacacgtgtgttggttaggggtagtgtgagtgtctgtccccagaaggatggatgagtaaaagtgttagatctcttcccagaaccaaggtgacaattagaagaaaagatgaaaggtacacagctagcaatacagatgtgtctggaaactacagccctgagtgaaaaaggaagaatgggatgcggaacacagtacccctaggtacactttacaagagtcctacagataagaagtacagattaaaagcattcgtaggaggtagggcaagaggtgttctagagcatacaagagcactgaacagtcccagcactctgggaggccaaggtgggtggatcacctgaggtcaggagttcgagaccagcctggccaacatcgcaaaaccctgtctctactaaacatacaaaaattagccgggcatggtggcaggtgcctgtaatcccagctactcaggaggctgaggcaagataatcacttgaacctgg

SEQ ID NO: 345580 - DNA, 695 bp, Homo sapiens
gaaggaccaagcagtactggagaatctgttaaatttattagcataaatgcttagacaaaacgagatataaatcattcagatgtattaagccataaagtatcccaatgaagtcagtcccttgccagggtcctggtgtataaatgttcatataaaacaaggtatcagtattatctttcaaactgaatatatgttgtaaaaatatccaaggttgagttaggaatatggggggagggtgcagcagggcaggaaggggatattctttagaccagtttgttaacatagtggtggctcagaaagtatggtggaaaggaaaaatttcaaccgtttacatttggagtcttcttagataatatgtttttaaataacggtatgcaggatatatttgagagcaaaggaataagagaaaaaaaagatgactagagggagaaaggcattgatttctgtagaatgcatttgtcccccaaagatcagtttagcttcacaaaaatccacccagaggaggcactggctcttcacacagataacggattatccagtagagaagagctacctgggccttcgtctggcaactgggatatgcagccgctggtcagcagagggatgtgtattcattagcggtggaagacgaggaaagcgcccgggagtgaggaagaggaatggacagaattcctggcagaagcttaccaagacaaaaa

SEQ ID NO: 345581 - DNA, 491 bp, Homo sapiens
aatcttgcacatgtaccccagaacttaaaaaaaaaaagttgaagggaaaaaaaaagcaaacttctgaattaataaagtgatggattatctaactataaagttgatgtgaaaaagaaaaaaaagcactgcagcaattccacttctgggtatatatccaaaaacactgaacacaaggactcaaacagatgtctgtactccagaattcacacagcattactcacaacagtcaaaagacaacccagtagtcaaaaagccacccaagtgtctaatacatgaatagataaaatgtggtatatccatacaatggaatattattcagccttaaaaaggaataaaactctaatacatgctacaacacagatgaaccttgaggacttatgctaagtgaaataagccacttgaaggacaaatactgcatgattccattcatctgagttatctagagtagccagattaatgaaagcagaatagaggttaccaggagctaaggg

SEQ ID NO: 345582 - DNA, 271 bp, Homo sapiens
attgtatgcctgtatcaaatatcttatgtaactcagaaatataaacatctactatgacccacaaaaattaaaaataatttttttaaaaaattggaaatacttgtagactgtagaattgttgcactgttttgtgtatagagaattatacaggaattatgggggtgcttgacaagtctctactccaaaaaacagagttaaacgatccaaatgaacaaaggcatcagactacaatagccatactcttaaccttggaaacaaccactcccctatg

SEQ ID NO: 345583 - DNA, 137 bp, Homo sapiens
tctggattcactatccttcattccaaagtacttcttgcatctgtcctttgagcaaggatctaagttccaagaagaacctgaaacggattaaagtcctaaatgtgaaaagcaaacttataaaaatgcataggagatac

SEQ ID NO: 345584 - DNA, 428 bp, Homo sapiens
gcggcctcttcaatatggcggggcctttgtctcctagcttccgggctctgatcctagttcgcgtctccactgttccatctcctccgttcctggagttcctcggtgactctactatagcttctgttatcctgtgacctgcaggtactgggagatccatagggaggacggcggaacatctggaggctgggaaatgggagtgttgacattcagggatgtggctgtagaattctccccagaagagtgggaatgcctggactctgctcagcagcgtttgtatagggatgtgatgttagagaactacggaaacctggtctccttgggtgagaataacttcaatatacaactcatattctacattaaatattttattttcttctgatttttttggaggctctgctttgcataaatgagtttcagaatcctgcttc

SEQ ID NO: 345585 - DNA, 660 bp, Homo sapiens
gcggcctcttcaatatggcggggcctttgtctcctagcttccgggctctgatcctagttcgcgtctccactgttccatctcctccgttcctggagttcctcggtgactctactatagcttctgttatcctgtgacctgcaggtactgggagatccatagggaggacggcggaacatctggaggctgggaaatgggagtgttgacattcagggatgtggctgtagaattctccccagaagagtgggaatgcctggactctgctcagcagcgtttgtatagggatgtgatgttagagaactacggaaacctggtctccttgggtcttgctatctttaagccagacttgatgacctgtctggagcaaagaaaagagccttggaaagtgaagagacaggaggcagtagccaaacacccaggtaggtgggagtgaatgaagcagatgacacaaatgacggatcccaatgtcaaggaggaagccaaacctttaaacatgcttccagaagctctgctccagtggaaatggtttctgagaaaccttcatttctttctcttgctttaacatagggacattttttgtcccattcttgtgaattttccaagcactgtacttccccttcagtaatgtgtgtgtgtgtgttgtgtgtgtgttttgttttgttt

SEQ ID NO: 345586 - DNA, 488 bp, Homo sapiens
ctggcttctaaataccattctccaataaaaatagccagggccccttggagaattggtaaattaccagacgagaaaaggaagacaagtctggaacatcttgaggtgccagaaaataaaggagtactaaacaatgatggcagcatattaaaaaggcacaagaaacaaccagaaagagctcccagtggccaaaactgaaacaattttagcaaaaaaaaaaaaaaaatgtatataagtattagattatagctcatggaataaaataattatgagtccacactgatttaaatatatacttgaataaataaataatttggggagaagagattactctttttaacagaattccagtccataaacaaaacaatattattgttgtagacaagatacaccaacagaggctaaaatcagtgagtgaaagtttgaagagaaacaggatattgcatagtctcatagtatgtccctaaatatatttattaactaccaaaaaa

SEQ ID NO: 345587 - DNA, 470 bp, Homo sapiens
gggattcaaaggtttgtgatttcaaaccttagcatttctagaggtaagtgtttttgttgtagaaatactgtatcgttttttaaaatgtgattttagagaacaaaatcttccctcattcagtttgtattcttgaagtattgaaaaatggatgacttctgaagtgagtcattttcagactgcataaaagtcttcgaaataaaatgactgtttattcatgctgtattgtgcttgactagtttgcttggttggccagagctgcatgctcagagggtcaggttttggcttcacacaggagtgatctcgacaagacacgtagggcagtgtgaacccacccttgctcctggaatagtccttccaaatgtgtagctcataaaatcacggtacttattttctctgaatctcctttgtcactagtcactgaacattgtggaatagagttatttgtgaactcagtcaagtagcacttgggg

SEQ ID NO: 345588 - DNA, 125 bp, Homo sapiens
ttgctcaatgatgaactcctgaaaactggatgataaactcacattttaaggcatttttcttctataattttgaggggtaacctgatcctggcagtaaagataaattaatggtagatactcactga

SEQ ID NO: 345589 - DNA, 1612 bp, Homo sapiens
gcgctaggtacgaggctgggtgttgcttccctgcttgatctgtgtaccctgctctttctccttcattccgcagcctcctttgccctgtgacctgcaggtactggacggtccctagagaggataccgggacgctcctgaagccgcgagatggatgggtcttccatgatactgaagggagagccacatgttgatgcccaggaccagctgcctccttggtctgaaaggcctgatcgaggccaggattggctatgagagctgggaaatgggaccatctttgaagccatgggagagggtgagagccaccatcactcatgttcttgaatgggaactgcctggagaccctgaagaagaaggagcctgaaggaggaaggaggaggctgagccatcccgggaacatgggctggatgaggccaagccaggagacgacaccaccagatagaagtcaccattcaggatttggacttttctgtggagatcctggccccgagatcgaacccttctccctgtgggtgttcccgcaggagatggtgctggagatccaccagctgttcatggaccatgaatacccatgtcaccacatcacttctcactgcacctgggtggcagcacactggaccacgtctcagagctgcgcagcatggcagggctgcaggcgggcttgctgctccacgtggtggaagagccctgcacaatgcacaaggcccacggtgatgagtgccacatttgagactgctcaggagcctggacccagctgatgcagctccttgtccttcctgagcgtcttcactgacagtggcctgagagacggcaggagcagaaagacttggagatggaccccaccgactgcacaccacccaagtacatcctgctagggaccctggaacagccactgtgtcccctgcaaccccagaacggtgactaaaagcccctgaaagtgctcaccgtgagcggctggtacctgtcccctgggaactgcaagatgcacaggaccttgtgtacctgtttgtgatcacagccgaggaccagcgaggtagcattaccacatccacacagggcttttaccataaccgccccagtactggaacgaggagctgcagatgatgagggacctacccaacaagaaccaacctgagcagctgcttcaagaaaaagccatgttcaaggtgcctgaatcccctggtaagtgagtgacagcctcacagcctcaggcccacctggctcctgctggaaggttttcttgtgctcgggagagaagtgagggaagccggcagtcccagccctgtcaggtgccctgaaggcccgtcaggtttgccctgcaaggccttctagcattctgcttcctgggagaccatcccccacctttctccggcctctgagactttgagtccttgggaggagaaggccctccttgctatctgggctgagtggccagggccatccagcttcccaccctccactgactgccatggggccctcccctgagcacatggtgcccaactgtagcccttctagggcaggggctcattggcagcacttgcagcttgctggcacttaaaagtcattagtgcggttactgagagaaatgaggaaaaaataattgttaaaaaaaaaa

SEQ ID NO: 345590 - DNA, 1813 bp, Homo sapiens
ctgggctggccttttcctctcccaggtgcgcttccctgcttgatctgtgtaccctgctctttctccttcattccgcagcctcctttgccctgtgacctgcaggtactggacggtccctagagaggataccgggacgctcctgaagccgcgagatgatttcaagcagatgcagcctgaccattagggccaaggccaaattgcaaaaaaaaaaagaagtttgcctttattctactccatccacatctaaactttggaggtcaaggctgtggacagatcagaagacatagttccctccttctggggctccacatccttcattcactgatctctgggaaggaggatgggtggcaggatgggtcttccatgatactgaagggagagccacatgttgatgcccaggaccagctgcctccttggtctgaaaggcctgatcgaggccaggattggctatgagagctgggaaatgggaccatctttgaagccatgggagagggtgagagccaccatcactcatgttcttgaatgggaactgcctggagaccctgaagaagaaggagcctgaaggaggaaggaggaggctgagccatcccgggaacatgggctggatgaggccaagccaggagacgacaccaccagatagaagtcaccattcaggatttggacttttctgtggagatcctggccccgagatcgaacccttctccctgtgggtgttcccgcaggagatggtgctggagatccaccagctgttcatggaccatgaatacccatgtcaccacatcacttctcactgcacctgggtggcagcacactggaccacgtctcagagctgcgcagcatggcagggctgcaggcgggcttgctgctccacgtggtggaagagccctgcacaatgcacaaggcccacggtgatgagtgccacatttgagactgctcaggagcctggacccagctgatgcagctccttgtccttcctgagcgtcttcactgacagtggcctgagagacggcaggagcagaaagacttggagatggaccccaccgactgcacaccacccaagtacatcctgctagggaccctggaacagccactgtgtcccctgcaaccccagaacggtgactaaaagcccctgaaagtgctcaccgtgagcggctggtacctgtcccctgggaactgcaagatgcacaggaccttgtgtacctgtttgtgatcacagccgaggaccagcgaggtagcattaccacatccacacagggcttttaccataaccgccccagtactggaacgaggagctgcagatgatgagggacctacccaacaagaaccaacctgagcagctgcttcaagaaaaagccatgttcaaggtgcctgaatcccctggtaagtgagtgacagcctcacagcctcaggcccacctggctcctgctggaaggttttcttgtgctcgggagagaagtgagggaagccggcagtcccagccctgtcaggtgccctgaaggcccgtcaggtttgccctgcaaggccttctagcattctgcttcctgggagaccatcccccacctttctccggcctctgagactttgagtccttgggaggagaaggccctccttgctatctgggctgagtggccagggccatccagcttcccaccctccactgactgccatggggccctcccctgagcacatggtgcccaactgtagcccttctagggcaggggctcattggcagcacttgcagcttgctggcacttaaaagtcattagtgcggttactgagagaaatgaggaaaaaataattgttaaaaaaaaaa

SEQ ID NO: 345591 - DNA, 214 bp, Homo sapiens
attgttgttttggggggttttttttgagatggagtctcactctgtcgaccaggctggatccgtctcaaaaaataaataaataaataaatggatgcttgcacactctctgacccagtatttattttacttatttttaccacaatttgttctagaaaagatatagtgataggtaaaatacaatcaaatgacataaattagaagtaggtgaaaagga

SEQ ID NO: 345592 - DNA, 262 bp, Homo sapiens
aacctgcaatattttacattcctaccagcaatgtacacatgtcaatttctctacctccttgcccacacttgctattttctttcttttcttatcccatcttagttggtgtccttttggtttgtatttctctaaccagtaatgatattaagcatcttttcatgtgcttattggccatttgtatgtctttatagaaatgtctattcaaattcattgcccctttttaaattagttatttatttatttatttgagatgaagtcttgc

SEQ ID NO: 345593 - DNA, 345 bp, Homo sapiens
tgacagtgtctcactttgttacccagagcgagacgcgagactccggctcaaaaaaaaaaaatttatttgcctgcaaatggatttactttatcctcgttcttaaaggactttttttcccttaggtgtgtaagattttaggttgacagtattttgtctctgcactttgcaaacaacgttctgtctctgggcatgggcagccgtagggtctgagcaggagccttggtttttggtgcttgtgctctgatgggctgacatgtatcctcagcctgtttagagtttgaggcctcttggatctgtggcttgaggccttcatcatgtttcttccagtgttgtttctgccccgtt

SEQ ID NO: 345594 - DNA, 795 bp, Homo sapiens
actccctcagtacattttaaacccagaaagacatcatttctaatgcctggtaacaccaacatttgcttagttttatttatatatttatcctttttgttgggcttcctgcattttttctactttttacttgggataatttgccttctgcctgaagaatatgagtgtgggtctgctggtgctgaattctgtcaatttttatttgccttggccaggcgcggtggctcacgcctgtaatcccagcactttgggaggccgagacaggcggatcacgaggtcaggagatcgagaccatcctggctaacacggtgaaaccctgtctctactaaacaaaatacaaaaaaattagctgggcgtggtgcgggcgcctgcagtcccagctactcgggaggctgaaaggcaggagaatggcgtgaacctgggaggcggagcttgcagtgagccaagatcccaccactgcactccagcctgggagacagagcgagacgcgagactccggctcaaaaaaaaaaaatttatttgcctgcaaatggatttactttatcctcgttcttaaaggactttttttcccttaggtgtgtaagattttaggttgacagtattttgtctctgcactttgcaaacaacgttctgtctctgggcatgggcagccgtagggtctgagcaggagccttggtttttggtgcttgtgctctgatgggctgacatgtatcctcagcctgtttagagtttgaggcctcttggatctgtggcttgaggccttcatcatgtttcttccagtgttgtttctgccccgtt

SEQ ID NO: 345595 - DNA, 610 bp, Homo sapiens
atgccgcatcctcgaaggtaccactcctcagagcgaggcagccgggggagttaccgtgaacactatcggagccgaaagcataagcgacgaagaagtcgctcctggtcaagtagtagtgaccggacacgacggcgtcggcgagaggacagctaccatgtccgttctcgaaggtgaggcctcaggaagagatactcaaacacagggtcactcgctcattcctttgttcaacaaatacttattggttatatgctaaaaccattgccttaagtagctggctgaaggtaatgtcgggatagataaccaaagaagccatttgggctgcagtgttaagtgttagaatacataatgaggaactgaggacgtacccagtgcgtttggttggagtggggcaggatgttaattcagataaaacattgcagagaaagcaacatctgtatatgtctggaggacaagtagagtcaggtgggggaagtgtctttgggcagagggaaagcatgtgcaaaggactgggagctacaggtaactaataagctaacagataagacaaagttagatctttgtgtttttaattttttaaaaattttaaaatatcatttatttatttttgaga

SEQ ID NO: 345596 - DNA, 435 bp, Homo sapiens
catcctcctttcttcagtgaacgaattaaaaaagagatgcagtgaagacacatttgcttcttatccacacatcacttcctctcactattagtcaatgtaggtagagctgagaatagcagtttcctgggaggacaaccacttcttagcgataaacaacacactgaaaaaaagtataaatcattcattaaaagctaacatattttaagaaaaataagcatatgcctgaataaaatgcttgtggaaaaataaagattcattttgttgatttctattgagctcagataacatttgactaaaagcttgcaaatatacagcagaaaaaacaatattatttgaaataagaattttgtgaataaagttattctgtcaatagaagtaaaaatattatgacctcatactaatagtctcatctatacttgtacaacattaaatgct

SEQ ID NO: 345597 - DNA, 241 bp, Homo sapiens
tcttctaagcacattatatatattaacttattaaattctcacaaaaatcctatgaggtaaatactattatcatccctatgttacagatgaggaaaatgttaaataacttacctagtgagtgtagcataggctctggtgtaaaaagctgattcaaacacctgccttgccactgtgaatcacggccctcagtcctttcctgtgaaaaattgatttttattttttttgagacaaggtcttaccc

SEQ ID NO: 345598 - DNA, 869 bp, Homo sapiens
tgtgcccagcctcactgttaaaattttaatcctagccacagtcctctcccacctggatagcttcctgcatcactgtggctgcccctagtcccacacaccacctcacaggtagagagaccttttggagccaggtagaaaggtttagactgaagagaataacctggaggagcaggaggcccctgtgctgcttggcagtggttggttaggccagaacatcgtgccattagcagtttgctcaaaccatgcagccctctaagctgtatatgatgtgccccacagcaaggcaccccaccagaaccaggaaataggggcgccttctgagagctgaacacgtggaagatcagaacagagacattcactgtcttacagggactaatgggctcccaacccagcaaatcttatctgtaaacccatcgaaagatacaatgtgtcagaaagcagactatcaatctgagagactcattcatttctgtgcatcccagtcctgtccaagagaccggaggcctgagtgcgctagctaaaacaagtgacaagaaagctaactaaccttgaaaaagtgggtctttattggcttatgctgaaaagtccaggggtagtttggcttcaggtgcagctggatccaggaacccaaacagtgtcattaagaccttgcccttgggccgggcatggtggctcatcacacttgtaatcccaacactttgggaggccgaggtgggtggatcatctgcagtcaggagttcaagaccagcctggccaacatggtgaaaccccgtctctactaaaaatacaaaaagtagctgggtgttgtggtgcacacctgtagtcccagctacttgggaggctgaggcaggagaattgtttgaacccag

SEQ ID NO: 345599 - DNA, 606 bp, Homo sapiens
tgaagtgaaagattaaaaggcactacaagagagttgagattatataataagctgtttcagcagtgagctgtgagaagaaaagtagtctcagtagctcctatgctaaaagacctatagctgctaacaatcgtcctccttccatctctagccatcaagtgtatgctaacaaaacagactaaaaaagttgttaacaaaccactgagaaggacaacatttaagcaggatgacatacaaaggaacaaatgcataaaaactaatcttggaatgaatcagtacagcttttagggaagtaccttatagcacactcagtttacttttgtaattgttgtatggcaatattttaagtagagaatttattttactgttacctataattatgtttaagttcaaccttttctctgatccaagtactaaccaggcctgaccctgcttcgctcccgagatcgggcgcgttaggtggtatggctgtagacaaggtaaaccttttctgagagaggaaaacgtctctagcagatgaagaggaattccaaagtcttgtttaggtcacatatttgtcactagagcatcaacgccacctatggataatttccatattactggtttgga

SEQ ID NO: 345600 - DNA, 1531 bp, Homo sapiens
cttcaatacaataatagttggggacttcaacaatctgctctcagcatttttaacagatcacctagacggaagaatcaacatagaaacattggattttaactggattttagtaagaacagaaaataaataagctggactttagatcaaatttgacttaacatttacaaaacattttattttatccaaaagctgcagaatacacattcttctcatcagcacatggaacattctccaggataggccatatgttaggccacaaaataaatctcaacacattttaaaattaagatcaaatcaagcatctttttaaactacaatggaataaaagtagaaataacaggagctttggaaactgtacaaatacatggaaattaaacaatatgctcctgaatgaccactgggtcgatgaagaaattgagaggaaatttttaaaaatatgtttttaaatatttaatatgaaaatagaaatgcaacatacccacacctatgggatacagaaaagcagtgctaaaagggaagtatatagcactaaatgcctatatcacaaaagcagaaatattttaaataaacagcctagtgatacacctcaaggaactagaaaaccaatgacaaaccaaacccaaaattagtagaaggaaaagtatagtaaatatcagaacaaaaacaaaatagagactaaaaaacaatacaaaggatcaagagacaaaaagtgcgtgttttaaaaaaaagatacacaaaattgataaacctcctagctagactaaccatgaaaaaaggaagaagagtcaaataaaatcagaaatgagaaagaagatattataactgataccacagaaacacaaaggatcatcagagattactatgaacaactatagccaacaaaatggaaaacctagaagagaaaatttttaatgttcctagcacaagaaaaagataaatgactgaggtgagagctatcctaaataccctggtttgatcattacaccttgcataattgtctcaaaatatgacatataccccataaatgcatataattgttatatgtctattaacaaaattttaaaaataaggactggatgtgggtgatgaataaatgaggatttggtatactattttctctacttcttatgttcaaaatattttataataagttaaaatgaataataaaataaccaaaaaagatctcaaaaactactatattttgtacattcatattacaggcacactttattgtacttcgctttattgctctttgtaggtattgagttttttacaaattgaaggtttgtgacaaccctgtatcaaggaagtctatcagtgccatttttttccaacagcatgtgctcactttttatctctatgtctcatttggtaattcacataatatttcaaactttttcattaataaataactgttatggtgatctgtgatcagtgatatttgatgttagtgttgtactatagggtgccaataactctgcctatacaagatggtgtacttaatcaataaacgtgtattctgactgcctta

SEQ ID NO: 345601 - DNA, 1008 bp, Homo sapiens
ggatttggtttgccagtattttattaagaatttttgcattgatgttcatcagggatattggcctgaaattttctttttttgttgtgtctctgccaggttttggtatcaggatgatgctggcttcataaaatgagttagggaggattccctctttttctattgttggaatagtttcagaaggaatgttcccagctcctctttgtacctctggtagaattcggctgtgaatctctctggtcctggacttttattggttggtaggctattaattgctgcctcagtttcagaacttgttataggtctattcagggatttgacctctttctggtttagtcttgggagggtgtatgtgtccagaaatttatccatttagaagagaaaatttttaatgttcctagcacaagaaaaagataaatgactgaggtgagagctatcctaaataccctggtttgatcattacaccttgcataattgtctcaaaatatgacatataccccataaatgcatataattgttatatgtctattaacaaaattttaaaaataaggactggatgtgggtgatgaataaatgaggatttggtatactattttctctacttcttatgttcaaaatattttataataagttaaaatgaataataaaataaccaaaaaagatctcaaaaactactatattttgtacattcatattacaggcacactttattgtacttcgctttattgctctttgtaggtattgagttttttacaaattgaaggtttgtgacaaccctgtatcaaggaagtctatcagtgccatttttttccaacagcatgtgctcactttttatctctatgtctcatttggtaattcacataatatttcaaactttttcattaataaataactgttatggtgatctgtgatcagtgatatttgatgttagtgttgtactatagggtgccaataactctgcctatacaagatggtgtacttaatcaataaacgtgtattctgactgcctta

SEQ ID NO: 345602 - DNA, 2911 bp, Homo sapiens
cttcaatacaataatagttggggacttcaacaatctgctctcagcatttttaacagatcacctagacggaagaatcaacatagaaacattggattttaactggattttagtaagaacagaaaataaataagctggactttagatcaaatttgacttaacatttacaaaacattttattttatccaaaagctgcagaatacacattcttctcatcagcacatggaacattctccaggataggccatatgttaggccacaaaataaatctcaacacattttaaaattaagatcaaatcaagcatctttttaaactacaatggaataaaagtagaaataacaggagctttggaaactgtacaaatacatggaaattaaacaatatgctcctgaatgaccactgggtcgatgaagaaattgagaggaaatttttaaaaatatgtttttaaatatttaatatgaaaatagaaatgcaacatacccacacctatgggatacagaaaagcagtgctaaaagggaagtatatagcactaaatgcctatatcacaaaagcagaaatattttaaataaacagcctagtgatacacctcaaggaactagaaaaccaatgacaaaccaaacccaaaattagtagaaggaaaagtatagtaaatatcagaacaaaaacaaaatagagactaaaaaacaatacaaaggatcaagagacaaaaagtgcgtgttttaaaaaaaagatacacaaaattgataaacctcctagctagactaaccatgaaaaaaggaagaagagtcaaataaaatcagaaatgagaaagaagatattataactgataccacagaaacacaaaggatcatcagagattactatgaacaactatagccaacaaaatggaaaacctagaggaaatgggtaaattcctggacacatacaaccttccaagattgaacctggaagaaatagaaaacctgaacagaccaataactggtaatgagattgaatcagtaataagtctcccaacaaagagaagcccagtagtggatgactttattgctgaaccctaccaaacctatagagaaaaactaacaccaattcttcacaaactgtttaaaaacaattgaagaggagggaatttttcctaactcattctacaaggccagcacaaccctgacaccaaaaccagagaaggacacaacgaaaaagaaagctacaggccaatatccctgatgaacacaggcataaaaatcatcaacaaaatgctagcaagctgaattcaacagtacaccaaaaagataatatactatggtcaagtgtgatttacccaaagatgcaaggatggtttaacacatgcaaatcaataaatgtgatgacatcagtggaatgaaggaaaaaactttatgattatctcaatagatgcagaaaattgtttgataaattcagtatcccttcatgataaaaaaaaaactctcaacaaattagacatacaaggaacatacctcaacataataaaggccatatatgacagattcacagctgacatcatactaaatggggaaaagctgaaagaccttcttctaaaaactggaaccagagcaggatgcccacattcaccactcttattcaacatagcactagaagttctagccagagcaatcaggcaagagaaataaataaaaagcatctaaattggaaaagagtaagtcaaattgtctctttctgtagatagcatgatcttatatatagacaacctaaagactttaccaagaaaaacccttacaactgataaattcagtaaaatatcagaatataatattagtagtattttgatgcatcaatgatgaaaaagctgaaaaagaaatcaggaagacaatcccatttacaataattaaaagataaaatacctcggatctaaccaaaaaggtgaaaggtctctacaagggaaactacaaaacactaatgaaagaaataaacaaatggaaagacattccatgtgcatgaatcagaagaattaatatcattaaaatgtttacccaaagtaaacttgattcaaagcaatctctatcaaaatactattgtcatttgtcacagaaattgaaaacaaaaataccaaagttcatatgaaatcaaaaaagaatcagaatagccaaagcaaccctgagcaaaaaagaaaaagctggaagcatcacactacttaacttcaaaacattacagggctatggtaacccaaagagcatggtattgatataaacagacacacagaccaatggaacagaatagaaaacccagaaataaatacatatatttaccaccaactgattttcaccaaaggtgccaagaatgtgtatcagggaagggataccctcttcgataaagggtactgagaaaactgaatattcatctgcaaaataatgaaactagacccctaatgtctcaccatacacaaaaattaaaatgattaaagacataaatataagacctgaaattatgaaactactggaagaaaccacaggggaaatgtttcaggacataggtcaaggcaaaaattttgtggctaagatctcaaaaacaaaaatagacaaatgggactatattaagctaaaaagattctgcaaaacaaaggaaacagtcaacagagtgaagagacaatctgtagaacaggaaaatatgtgcaaactatttatccaacaagggactaatattgagaatatacaaggaattcaacagcaaaaaaaaaatcccttttaaaaagtaggcaaaggacatgaagagacatttctcaaaagaagacatacaaatggccaagtatatgaaaaaatgtttaacatcactagccatcagggaaatgcatatcaaaaccacaatgagatatcaccttaccccacttagaatgactattattaaaaagaccaaaaaaaaaa

SEQ ID NO: 345603 - DNA, 463 bp, Homo sapiens
tctgctgtcctgaattgtacacgtgggaactgaaggagaccccggaatctggagacacagaggtctctagggccttagaaaagctgatagatggggcgtgctgcgaagtccaggccgagccttagacttgggaggtgggcgtgggaaggaggtcagggaaggaggctgttaaacctctgggaaatatggaccctccttaatacttcctattcaacaactattaataacagttgtgataaattaaggaacaggagccatgtgacaggcttgtctgaagcactttacatacatttccttatttcatcctcatagtacccttatgagctctgagttagattcagaggggaaaaaaacttgcccaaaatgcacagctaacaagttagcaaggaataaagacagggttggtgtccagggctgtctggctccagggcctgagaacttagctcttcttctaggccactcc

SEQ ID NO: 345604 - DNA, 431 bp, Homo sapiens
tgaagacattccttggatcatttagatgccggcaaggtccagtaattgtttcttattgctctctatgattccatgaagattaacatgtaaaatattttgagcatatggattttttattccacatataaagaaaatattcagtgatcatagagtgactgaaagcttggatggagcttcaatatctcttattagctgagctgtcttgcacaagttatttaacttgttaacagtctccatttcttatctttgtaaaatagggataatgataatacttcctcctagggttgttaggatggacaaaggagataatgatgggccaggcacttaccacattgcctgcattaaatactgggggaggttggctcttaatcactatgttggccctttaaggggacaaatacttttaaatttccctaataatttggaaggta

SEQ ID NO: 345605 - DNA, 603 bp, Homo sapiens
aagctgctggaggctagattgaccagaaaaatggggccaatatcatgattcctcagcagtgcctggagaagaccaggagaggaagcagaagaccctcctcaaagaagcagccttcacctccagacctcccagcgggacttagacaatggggttaggcagtcacatgtctgcacgtggaaactttctgggactgtgcttggatcctggctctgccttttactagccatgtgaccttgggaaaatcacttgacttctccgtgcaggattcctcatctgtaaaaatggtctaagattaggagccacctcaaggttgttgtaggaattaaattaattcatgtttataaagtgctttgaacagcgtttggcacatggtaagtgctatgtggtaagtgctgtctattgattacataaataaaagtgatcaccattagactttccatgcagatgatattatgcatatacatatctcccgcatatgacgtcattggatcgttttgcaatggtggggggtttattcttttcctttttgttttcttcttttttttgtcagatgaagaaactgatgggaagtgaattggtttgtattaaacattaggtttgcta

SEQ ID NO: 345606 - DNA, 1380 bp, Homo sapiens
taatttctcccctagcaagaatgaggaagatgaagagctcgggtatctgagggctggtgtgtctgcatgcgtgtgtgttttgggggccgactgaaggaagagaaggctggagagagggaacatgggtctgagggcacatcgctaaggggtcaagaggcctaaagggggagtctaaggctctccatcgaacttggacttggtctacattagactttaacctccatgaggcttggactttcaggcttcctccctcacaccgcgggcaggtgaggcgtctgctacaggcctggtctcgcagagggggcccagcgccccccgccgccgccttctcctggagtctgtgtgacagaatgggacctgtgggaaagcagcacgtcagcacccagccccgcttgcgcgccagcagctaattaaagccaggaaggtgatggcgattttcaactcattcccgttacaaacagccgaccttcctaccgagttcaagtaccttctgcctggcctggaagaacaatatctctctgtctccctcttccactggccctcacctgccttcccctgaacatgcattttgcctgacaggagacagaggcagttgatgcttgcagcttggtccaggaggccagcaggaccagagagaagaccacagcgacacatggggatggctgtcccacaggcagaaatgagcagccgggaggaagcccaggcagccagccacccagctccctccacatcgtggccctagaacggagtcttgaagaataagaagccacagcttgtcagggaatcaggctggaaaaatgttatgagactgagtaagaccagagattcctcagcagtgcctggagaagaccaggagaggaagcagaagaccctcctcaaagaagcagccttcacctccagacctcccagcgggacttagacaatggggttaggcagtcacatgtctgcacgtggaaactttctgggactgtgcttggatcctggctctgccttttactagccatgtgaccttgggaaaatcacttgacttctccgtgcaggattcctcatctgtaaaaatggtctaagattaggagccacctcaaggttgttgtaggaattaaattaattcatgtttataaagtgctttgaacagcgtttggcacatggtaagtgctatgtggtaagtgctgtctattgattacataaataaaagtgatcaccattagactttccatgcagatgatattatgcatatacatatctcccgcatatgacgtcattggatcgttttgcaatggtggggggtttattcttttcctttttgttttcttcttttttttgtcagatgaagaaactgatgggaagtgaattggtttgtattaaacattaggtttgcta

SEQ ID NO: 345607 - DNA, 1597 bp, Homo sapiens
taatttctcccctagcaagaatgaggaagatgaagagctcgggtatctgagggctggtgtgtctgcatgcgtgtgtgttttgggggccgactgaaggaagagaaggctggagagagggaacatgggtctgagggcacatcgctaaggggtcaagaggcctaaagggggagtctaaggctctccatcgaacttggacttggtctacattagactttaacctccatgaggcttggactttcaggcttcctccctcacaccgcgggcaggtgaggcgtctgctacaggcctggtctcgcagagggggcccagcgccccccgccgccgccttctcctggagtctgtgtgacagaatgggacctgtgggaaagcagcacgtcagcacccagccccgcttgcgcgccagcagctaattaaagccaggaaggtgatggcgattttcaactcattcccgttacaaacagccgaccttcctaccgagttcaagtaccttctgcctggcctggaagaacaatatctctctgtctccctcttccactggccctcacctgccttcccctgaacatgcattttgcctgacaggagacagaggcagttgagatggagtcttgctatatggcccagctggtaatgcctagattcttgagtccctccctggctcatccctgggagcagcactgaaccccttgtctgacacctgtctggaaatggagcctgcacattgaccctagccatgtgtggtcttgttactaagtgttagccagtgagagaacatacaagaggaggcccatgttgattcagaggatgaatgagagatgcttgcagcttggtccaggaggccagcaggaccagagagaagaccacagcgacacatggggatggctgtcccacaggcagaaatgagcagccgggaggaagcccaggcagccagccacccagctccctccacatcgtggccctagaacggagtcttgaagaataagaagccacagcttgtcagggaatcaggctggaaaaatgttatgagactgagtaagaccagagattcctcagcagtgcctggagaagaccaggagaggaagcagaagaccctcctcaaagaagcagccttcacctccagacctcccagcgggacttagacaatggggttaggcagtcacatgtctgcacgtggaaactttctgggactgtgcttggatcctggctctgccttttactagccatgtgaccttgggaaaatcacttgacttctccgtgcaggattcctcatctgtaaaaatggtctaagattaggagccacctcaaggttgttgtaggaattaaattaattcatgtttataaagtgctttgaacagcgtttggcacatggtaagtgctatgtggtaagtgctgtctattgattacataaataaaagtgatcaccattagactttccatgcagatgatattatgcatatacatatctcccgcatatgacgtcattggatcgttttgcaatggtggggggtttattcttttcctttttgttttcttcttttttttgtcagatgaagaaactgatgggaagtgaattggtttgtattaaacattaggtttgcta

SEQ ID NO: 345608 - DNA, 693 bp, Homo sapiens
aggatggggtaaaccactcccatgattcaattatctcccactgggtccctcccatgtcacatggggattatgggagctacaattcaagatgagctttgggtggggacacagccaaaccatatcaccatctgtggaaccctcatcatctgctttgagaaaggacccagagtcagcttcattttacagctaaagtctgaagcttggaaagttttcataattagcccaagctcattgggccacggaacggtgaggagatctgactatctctgacaccacagattttctctgaactgctcttgtgagccaacttccagctgactgcctaagagggcagcaatagtttagctaagatttagagtcagtacttaaacaatagcttcatatttcattatgggaagtaagccatgcaaaagtgctttattgttgtagtatgtatacacacacacacacacacacacgcacacacacacgcacagcaggcagacaatgcaaaggaaatataccctccagccgcttcctactaaaaatatgctgtgatttgtggacctgcaacacggggtccctagaacgtctagtcccatcctagtcctgctgccccagcgtctgcatttaacaagtttatgcagattccagaagccctgctaggagcagcatctttgcctgccttccatgttctgcttgctacaacccctc

SEQ ID NO: 345609 - DNA, 570 bp, Homo sapiens
  misc_feature (514)..(514): n is a, c, g, or t
aggatggggtaaaccactcccatgattcaattatctcccactgggtccctcccatgtcacatggggattatgggagctacaattcaagatgagctttgggtggggacacagccaaaccatatcaccatctgtggaaccctcatcatctgctttgagaaaggacccagagtcagcttcattttacagctaaagtctgaagcttggaaagttttcataattagcccaagctcattgggccacggaacggtgaggagatctgactatctctgacaccacagattttctctgaactgctcttgtgagccaacttccagctgactgcctaagagggcagcaatagtttagctaagatttagagtcagtacttaaacaatagcttcatatttcattatgggaagtaagccatgcaaaagtgctttattgttgtagtatgtatacacacacacacacacacacacgcacacacacacgcacagcaggcagacaatgcaaaggaaatataccctcttgccgncgtcctcatcctaaacctgacttccctaattccccccatccttaccaccctcgttt

SEQ ID NO: 345610 - DNA, 820 bp, Homo sapiens
cgccgcgcccattcagggactgcgttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggtgagatacagagtgggtacaggatgctgaagggcccctaaaaattcgcagttgcactcctgcagtattctgagatgtctggagctcagttacgattcccttttccaggccgggcgtggtggctcacacctgtaatcccagcactttgggaggctgaggcaggcggatcacttgaggtcaggcgtttgagaccagcttggccaacatggtgaaacc

SEQ ID NO: 345611 - DNA, 668 bp, Homo sapiens
ttcgaatagtatgctgcttgggcacgctggatcatccagtgtgcagaacaatgaagatagaccgttacctcttgccatatatcagcagcacgtcacaatgaatcacagatttaaactctcgcatacctcgaagctagtgagactactagtggcaacatggtgaatcctggtaatcctgtctagtagtcaacctgccggggtgccagatggtacagtggtccgccgcctgacaacgtcgggactgtgatagagtcagtgcactttcggacagactgctctctgattcagagctcagctgggcccccagttccagaccccagcattcccggtcactccctccctaatctgagcatcactcaagctctttattaaactcaatttgggccagatttggtggctcatgcctgtaatcctaacactctgggaggccgaggcgggcggatcacttgaggtgaggagtttgagaccagcctggccaacatggtgaaaccctgtctccactaaaaatacaaaaacaattggctggacatggtggcatgcgcctgtagtcccagctacttgggaggctgaggcagaagaattgattgaacccaggaggcggaggttgcagtgagccgagattgtgccactgcactccagcctaggtgacaaagagagactctgtctca

SEQ ID NO: 345612 - DNA, 2626 bp, Homo sapiens
cgccgcgcccattcagggactgcgttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgtgagtataagggatagggttgtctgcagactcttggcttggtgggggctgttctcacggctgtcccccacctgtcctcaggctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggctgtgcttaactctggggtccaggttgacctggaagccagagacttcgagggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccagagatgaggtcttgctgtgttgtccaggctggtctgcagctcctggcctcaagtgatcctccttcttcagcttcccaaagtgctaggattacaggcgtgaaccaccgcactccgccaagggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagctcttcgttcccagaaacccagatgtaatccccctacgtggtgcttggggcatcccgataccatctcagtaaatctcctacaatggcctcctcaccctccccgggacccacacccttcaggtcctcaccctgagacaggagggaccctctgagatcagggacccttaggtctcactgctctctgattcagagctcagctgggcccccagttccagaccccagcattcccggtcactccctccctaatctgagcatcactcaagctctttattaaactcaatttgggccagatttggtggctcatgcctgtaatcctaacactctgggaggccgaggcgggcggatcacttgaggtgaggagtttgagaccagcctggccaacatggtgaaaccctgtctccactaaaaatacaaaaacaattggctggacatggtggcatgcgcctgtagtcccagctacttgggaggctgaggcagaagaattgattgaacccaggaggcggaggttgcagtgagccgagattgtgccactgcactccagcctaggtgacaaagagagactctgtctca

SEQ ID NO: 345613 - DNA, 2542 bp, Homo sapiens
cgccgcgcccattcagggactgcgttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggctggaccctggagagtttctgcacccccttcaggacccccacagttccccgctgtggtccctggaccatcgctggaggtggcccgagctcacatgctggctttggggccacagcagctgctggcccaggatgaggagggggacacgtgagtataagggatagggttgtctgcagactcttggcttggtgggggctgttctcacggctgtcccccacctgtcctcaggctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggtatggccagctggcaggcaggggtttgtctggggggtagactggttgcccagattttggcttccagggccaggaggccaggggatacccttacccagcagtctgccttctcttcctcccaggctgtgcttaactctggggtccaggttgacctggaagccagagacttcgagggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccagagatgaggtcttgctgtgttgtccaggctggtctgcagctcctggcctcaagtgatcctccttcttcagcttcccaaagtgctaggattacaggcgtgaaccaccgcactccgccaagggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagctcttcgttcccagaaacccagatgtaatccccctacgtggtgcttggggcatcccgataccatctcagtaaatctcctacaatggcctcctcaccctccccgggacccacacccttcaggtcctcaccctgagacaggagggaccctctgagatcagggacccttaggtctcactgctctctgattcagagctcagctgggcccccagttccagaccccagcattcccggtcactccctccctaatctgagcatcactcaagctctttattaaactcaatttgggccagatttggtggctcatgcctgtaatcctaacactctgggaggccgaggcgggcggatcacttgaggtgaggagtttgagaccagcctggccaacatggtgaaaccctgtctccactaaaaatacaaaaacaattggctggacatggtggcatgcgcctgtagtcccagctacttgggaggctgaggcagaagaattgattgaacccaggaggcggaggttgcagtgagccgagattgtgccactgcactccagcctaggtgacaaagagagactctgtctca

SEQ ID NO: 345614 - DNA, 2436 bp, Homo sapiens
cgccgcgcccattcagggactgcgttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgtgagtataagggatagggttgtctgcagactcttggcttggtgggggctgttctcacggctgtcccccacctgtcctcaggctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggctgtgcttaactctggggtccaggttgacctggaagccagagacttcgagggtaagttgggtgtgggcagggctggtgtggttggtgtggctgggcgaggtgggtgcagatgcgggtccctcactgtctccattctgcaggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccagagatgaggtcttgctgtgttgtccaggctggtctgcagctcctggcctcaagtgatcctccttcttcagcttcccaaagtgctaggattacaggcgtgaaccaccgcactccgccaagggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagctcttcgttcccagaaacccagatgtaatccccctacgtggtgcttggggcatcccgataccatctcagtaaatctcctacaatggcctcctcaccctccccgggacccacacccttcaggtcctcaccctgagacaggagggaccctctgagatcagggacccttaggtctcactgctctctgattcagagctcagctgggcccccagttccagaccccagcattcccggtcactccctccctaatctgagcatcactcaagctctttattaaactcaatttgggccaga

SEQ ID NO: 345615 - DNA, 2191 bp, Homo sapiens
cgccgcgcccattcagggactgcgttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggaccccccagacacccagttctatgtaggatcttctctgccacagctggaccctggagagtttctgcacccccttcaggacccccacagttccccgctgtggtccctggaccatcgctggaggtggcccgagctcacatgctggctttggggccacagcagctgctggcccaggatgaggagggggacacgctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggctgtgcttaactctggggtccaggttgacctggaagccagagacttcgagggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccaggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagctcttcgttcccagaaacccagatgtaatccccctacgtggtgcttggggcatcccgataccatctcagtaaatctcctacaatggcctcctcaccctccccgggacccacacccttcaggtcctcaccctgagacaggagggaccctctgagatcagggacccttaggtctcactgctctctgattcagagctcagctgggcccccagttccagaccccagcattcccggtcactccctccctaatctgagcatcactcaagctctttattaaactcaatttgggccaga

SEQ ID NO: 345616 - DNA, 2352 bp, Homo sapiens
cgccgcgcccattcagggactgcgttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggctggaccctggagagtttctgcacccccttcaggacccccacagttccccgctgtggtccctggaccatcgctggaggtggcccgagctcacatgctggctttggggccacagcagctgctggcccaggatgaggagggggacacgtgagtataagggatagggttgtctgcagactcttggcttggtgggggctgttctcacggctgtcccccacctgtcctcaggctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggtatggccagctggcaggcaggggtttgtctggggggtagactggttgcccagattttggcttccagggccaggaggccaggggatacccttacccagcagtctgccttctcttcctcccaggctgtgcttaactctggggtccaggttgacctggaagccagagacttcgagggtaagttgggtgtgggcagggctggtgtggttggtgtggctgggcgaggtgggtgcagatgcgggtccctcactgtctccattctgcaggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccagagatgaggtcttgctgtgttgtccaggctggtctgcagctcctggcctcaagtgatcctccttcttcagcttcccaaagtgctaggattacaggcgtgaaccaccgcactccgccaagggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagctcttcgttcccagaaacccagatgtaatccccctacgtggtgcttggggcatcccgataccatctcagtaaatctcctacaatggcctcctcaccctccccgggacccacacccttcaggtcctcaccctgagacaggagggaccctctgagatcagggacccttaggtctcactgctctctgattcagagctcagctgggcccccagttccagaccccagcattcccggtcactccctccctaatctgagcatcactcaagctctttattaaactcaatttgggccaga

SEQ ID NO: 345617 - DNA, 2202 bp, Homo sapiens
cgccgcgcccattcagggactgcgttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgtgagtataagggatagggttgtctgcagactcttggcttggtgggggctgttctcacggctgtcccccacctgtcctcaggctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggctgtgcttaactctggggtccaggttgacctggaagccagagacttcgagggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccagagatgaggtcttgctgtgttgtccaggctggtctgcagctcctggcctcaagtgatcctccttcttcagcttcccaaagtgctaggattacaggcgtgaaccaccgcactccgccaagggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagctcttcgttcccagaaacccagatgtaatccccctacgtgtccggccaccacgtatggctcggacacgtgtgggaagaaagcttagatttacgccgatgaatatgatagtgaaatggattttggcgtaggtttggtctaggtgtag

SEQ ID NO: 345618 - DNA, 1885 bp, Homo sapiens
cgccgcgcccattcagggactgcgttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgtgagtataagggatagggttgtctgcagactcttggcttggtgggggctgttctcacggctgtcccccacctgtcctcaggctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggctgtgcttaactctggggtccaggttgacctggaagccagagacttcgagggtaagttgggtgtgggcagggctggtgtggttggtgtggctgggcgaggtgggtgcagatgcgggtccctcactgtctccattctgcaggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccagagatgaggtcttgctgtgttgtccaggctggtctgcagctcctggcctcaagtgatcctccttcttcagcttcccaaagtgctaggattacaggcgtgaaccaccgcactccgccaagggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgagggggtaagtaagcactgagcctgcctgtagagtggcctctgagctcgcgggcgcgggatgacctccctgccccacccaatgctcgctttcagagaatgacttctaatctcgga

SEQ ID NO: 345619 - DNA, 313 bp, Homo sapiens
gtgaagaagcttctggaagagcagaggcgccgccagcagcagcagcccgacgctggcggggtgcaggtgaggccagggagccacagctctccggaggccccgtgctgtcccgtagggactcagcggcttgccgggccctcggggctgatgagaggggtggtcctgaccgaaatgtcttatagatccgagacagacccggaggaatctgccagataaagtcacctgggttcctttttgcttttgtctctacagggacaatttctccctcccccagagcagcccctgaccccatctgtgaatgaggctgtgactg

SEQ ID NO: 345620 - DNA, 743 bp, Homo sapiens
gcccctccctctgcatggcgtgccttccccacctctccttccaacctgacagacttctctccctcctttgccttgtctacagctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagctcttcgttcccagaaacccagatgtaatccccctacgtggtgcttggggcatcccgataccatctcagtaaatctcctacaatggcctcctcaccctccccgggacccacacccttcaggtcctcaccctgagacaggagggaccctctgagatcagggacccttaggtctcactgctctctgattcagagctcagctgggcccccagttccagaccccagcattcccggtcactccctccctaatctgagcatcactcaagctctttattaaactcaatttgggccaga

SEQ ID NO: 345621 - DNA, 2711 bp, Homo sapiens
cgccgcgcccattcagggactgcgttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggaccccccagacacccagttctatgtaggatcttctctgccacagctggaccctggagagtttctgcacccccttcaggacccccacagttccccgctgtggtccctggaccatcgctggaggtggcccgagctcacatgctggctttggggccacagcagctgctggcccaggatgaggagggggacacgctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggtatggccagctggcaggcaggggtttgtctggggggtagactggttgcccagattttggcttccagggccaggaggccaggggatacccttacccagcagtctgccttctcttcctcccaggctgtgcttaactctggggtccaggttgacctggaagccagagacttcgagggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccagagatgaggtcttgctgtgttgtccaggctggtctgcagctcctggcctcaagtgatcctccttcttcagcttcccaaagtgctaggattacaggcgtgaaccaccgcactccgccaagggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagctcttcgttcccagaaacccagatgtaatccccctacgtggtgcttggggcatcccgataccatctcagtaaatctcctacaatggcctcctcaccctccccgggacccacacccttcaggtcctcaccctgagacaggagggaccctctgagatcagggacccttaggtctcactgctctctgattcagagctcagctgggcccccagttccagaccccagcattcccggtcactccctccctaatctgagcatcactcaagctctttattaaactcaatttgggccagatttggtggctcatgcctgtaatcctaacactctgggaggccgaggcgggcggatcacttgaggtgaggagtttgagaccagcctggccaacatggtgaaaccctgtctccactaaaaatacaaaaacaattggctggacatggtggcatgcgcctgtagtcccagctacttgggaggctgaggcagaagaattgattgaacccaggaggcggaggttgcagtgagccgagattgtgccactgcactccagcctaggtgacaaagagagactctgtctca

SEQ ID NO: 345622 - DNA, 2347 bp, Homo sapiens
cgccgcgcccattcagggactgcgttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgtgagtataagggatagggttgtctgcagactcttggcttggtgggggctgttctcacggctgtcccccacctgtcctcaggctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggctgtgcttaactctggggtccaggttgacctggaagccagagacttcgagggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccagagatgaggtcttgctgtgttgtccaggctggtctgcagctcctggcctcaagtgatcctccttcttcagcttcccaaagtgctaggattacaggcgtgaaccaccgcactccgccaagggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagctcttcgttcccagaaacccagatgtaatccccctacgtggtgcttggggcatcccgataccatctcagtaaatctcctacaatggcctcctcaccctccccgggacccacacccttcaggtcctcaccctgagacaggagggaccctctgagatcagggacccttaggtctcactgctctctgattcagagctcagctgggcccccagttccagaccccagcattcccggtcactccctccctaatctgagcatcactcaagctctttattaaactcaatttgggccaga

SEQ ID NO: 345623 - DNA, 2228 bp, Homo sapiens
cgccgcgcccattcagggactgcgttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgtgagtataagggatagggttgtctgcagactcttggcttggtgggggctgttctcacggctgtcccccacctgtcctcaggctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggctgtgcttaactctggggtccaggttgacctggaagccagagacttcgagggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccaggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagctcttcgttcccagaaacccagatgtaatccccctacgtggtgcttggggcatcccgataccatctcagtaaatctcctacaatggcctcctcaccctccccgggacccacacccttcaggtcctcaccctgagacaggagggaccctctgagatcagggacccttaggtctcactgctctctgattcagagctcagctgggcccccagttccagaccccagcattcccggtcactccctccctaatctgagcatcactcaagctctttattaaactcaatttgggccaga

SEQ ID NO: 345624 - DNA, 2477 bp, Homo sapiens
cgccgcgcccattcagggactgcgttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggtatggccagctggcaggcaggggtttgtctggggggtagactggttgcccagattttggcttccagggccaggaggccaggggatacccttacccagcagtctgccttctcttcctcccaggctgtgcttaactctggggtccaggttgacctggaagccagagacttcgagggtaagttgggtgtgggcagggctggtgtggttggtgtggctgggcgaggtgggtgcagatgcgggtccctcactgtctccattctgcaggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccagagatgaggtcttgctgtgttgtccaggctggtctgcagctcctggcctcaagtgatcctccttcttcagcttcccaaagtgctaggattacaggcgtgaaccaccgcactccgccaagggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagctcttcgttcccagaaacccagatgtaatccccctacgtggtgcttggggcatcccgataccatctcagtaaatctcctacaatggcctcctcaccctccccgggacccacacccttcaggtcctcaccctgagacaggagggaccctctgagatcagggacccttaggtctcactgctctctgattcagagctcagctgggcccccagttccagaccccagcattcccggtcactccctccctaatctgagcatcactcaagctctttattaaactcaatttgggccaga

SEQ ID NO: 345625 - DNA, 1755 bp, Homo sapiens
  misc_feature (1725)..(1725): n is a, c, g, or t
cgccgcgcccattcagggactgcgttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgtgagtataagggatagggttgtctgcagactcttggcttggtgggggctgttctcacggctgtcccccacctgtcctcaggctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggctgtgcttaactctggggtccaggttgacctggaagccagagacttcgagggtaagttgggtgtgggcagggctggtgtggttggtgtggctgggcgaggtgggtgcagatgcgggtccctcactgtctccattctgcaggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccagaggtgagcggggatgtgggcggtcagaccctgggagattgtgtggaatggggccacttggatgtccgggagctccaggcaaatgctgactttgcctcttccttgctgcgtgcccttgaacatgttacttcacttctctgtgccttaggggttttttgtttgtttctttgtttgttttgagatggagttttgctcttgttgccctggctggagtgcaatggtgtgatcttggctcaccgcaacctctgcatcccgggttcaagtgattctcctgcctcagcctcctgagtagctgggattacaggcatgagtcaccacgcctggctaatttttttgtattgtagtagtagcngcagcggggacctctagatcaccacacgat

SEQ ID NO: 345626 - DNA, 1366 bp, Homo sapiens
cgccgcgcccattcagggactgcgttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgtgagtataagggatagggttgtctgcagactcttggcttggtgggggctgttctcacggctgtcccccacctgtcctcaggctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggctgtgcttaactctggggtccaggttgacctggaagccagagacttcgagggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccagcaaggagatcaagtgcttctagacagatatgaactaggtctttcaggtaaaaaccccacgggggttcccccactaagatta

SEQ ID NO: 345627 - DNA, 302 bp, Homo sapiens
gtttgtcaaaagaagccagatgactccacagtctttacatcaccactccatcaccatagccactaagtcccatagccactggatgttcccacacctctccctccatctgcacttcatggcttgataccttgcagtgatgatatgagtaatcatgatgccaccatgtaccaagaattacccacatcctattttccccttacccctctgaaggaaataacctctgtgttcttgaacatatacacaacccaatcccaaaatcctgctttgagattctgttttcggagcataaattgaaccaactt

SEQ ID NO: 345628 - DNA, 520 bp, Homo sapiens
cttgatggggttgggactttgttcactaggtatgaacccattgcctagaaatctgaagaagggtatattgcaggttcttacgggtattcctaggaagaagaaatgatttccaaacagaattagcatgtagaggagaaacgcacaaagaaaaggagatttgatttccacaatgtaaggaaatgtaaaatttcattagaagaaagggaaagaggacattgccagcaaagatggagagaaagaaggcgtgtttaaataagctggtttccaatttagctgaaacatttgaaagtaaacagaagtagagctagatttaggggtgtaagatgtgggcaattaatacatttatatggctcaaaatttgaagagttggaaagcatctacagtgaaaagccccttttcctgccccatttcctcagccactcaggctattccccagagtcactgtgcataattacatatataatacaaacatgtatactatttctcttccctcttttatttttccaaaatggtatcaaac

SEQ ID NO: 345629 - DNA, 303 bp, Homo sapiens
agacaggatctcatcatcttgcacacactggtctcaaactcctgggctcaagtgatcctcttgccttggcctcccaaaatattgggattacaggtgtgagccacaggtcccagccaaaatggtctctcttaagaatgcttttcttaccatcttaaaaaagttgaacaagaaaaggcattttctcgttgcctctgggccactgatatgaacattactgagcgatgacacaataaggggactacaggatgttcagtggtgtctgttctgtaggacgcaggtctggaggtaagcctggcgtgggtt

SEQ ID NO: 345630 - DNA, 540 bp, Homo sapiens
ctaccaaacagtgagatcaaaaatgggtactgctttaagatgccaagtttgtggcaacgggttatggtggcaacaggaaatgaatatgctcccattctgcagatgaggcacctgaggctctgaaaggttaggaacttgcccaaggaccacagatgggtcctcacaatgcagaggggagtccgagctccagctctctgactccagagcctgtgctcgtactcacagccctctccaggccacacactcagggtcgcatcttatcaggaatcgcactcagaaagggctgacttgccagtgccatgagccaactttggctatgcagttgtatgcagggattaagaatggcttgattgggcttacaccaaaacacatttcttcctgcttttctcaactactctcggtggctaaaaccaacttatcaaccgtctatccatccaacgttccacagataattcacatggcgcctgcgagctgctatgccaactgatttaccccttcttactgtcctttcccaagtgagaatttaaagtcttttagtga

SEQ ID NO: 345631 - DNA, 929 bp, Homo sapiens
ctccacaggaggtacagctgcttacacatctctcctcagagctgtcccttgacttgggggtgaatttcaggccaacagggcttcctgggatacaagagcgttctccatggatctgccttactaccatggacgtctgaccaagcaagactgtgagaccttgctgctcaaggaaggggtggatggcaactttcttttaagagacagcgagtcgataccaggagtcctgtgcctctgtgtctcgtttaaaaatattgtctacacataccgaatcttcagagagaaacacgggtattacaggatacagactgcagaaggttctccaaaacaggtctttccaagcctaaaggaactgatctccaaatttgaaaaaccaaatcaggggatggtggttcaccttttaaagccaataaagagaaccagccccagcttgagatggagaggattgaaattagagttggaaacatttgtgaacagtaacagcgattatgtggatgtcttgccttgaagataaggctgccggacaaagcaagttgaagagatgagtaacagttctcactgatgacccacttctgcaggcataggtccagagcaccaaactctagtggacaattcagactctcctggttgtgtaactgaagatgttctgcccaccagcaccagaggtcactctccacatccccgcctcccagacatataccaggagcaatttcaaaaccctctccagtttcactcttctttcttggaatgggacagcctgaacattttccctttgacttgttaaaggtaccaccctacatcatggttgacaccctcctttggaccatgcagtcagaggggcagctttatacagaggaggggcacacttgtctgtgagtttgaagccctgagttccagtcctgtggctgtgtgactttgaacacgtttctgcc

SEQ ID NO: 345632 - DNA, 790 bp, Homo sapiens
aaactgccaaactgttttccaaagtgatcatgcgatctcactattcccatgggcattacatgagttctgattgctctacatccttaccaacatgtggaacggtttaaaaatattgtctacacataccgaatcttcagagagaaacacgggtattacaggatacagactgcagaaggttctccaaaacaggtctttccaagcctaaaggaactgatctccaaatttgaaaaaccaaatcaggggatggtggttcaccttttaaagccaataaagagaaccagccccagcttgagatggagaggattgaaattagagttggaaacatttgtgaacagtaacagcgattatgtggatgtcttgccttgaagataaggctgccggacaaagcaagttgaagagatgagtaacagttctcactgatgacccacttctgcaggcataggtccagagcaccaaactctagtggacaattcagactctcctggttgtgtaactgaagatgttctgcccaccagcaccagaggtcactctccacatccccgcctcccagacatataccaggagcaatttcaaaaccctctccagtttcactcttctttcttggaatgggacagcctgaacattttccctttgacttgttaaaggtaccaccctacatcatggttgacaccctcctttggaccatgcagtcagaggggcagctttatacagaggaggggcacacttgtctgtgagtttgaagccctgagttccagtcctgtggctgtgtgactttgaacacgtttctgcc

SEQ ID NO: 345633 - DNA, 208 bp, Homo sapiens
ctgttactgctcttatcttcattcttgtctacaatacacatggctataactgcaggacatgcaagttctgaataggtgatatatttctgtatcatgtccagactgaggaaaacaataagctcttacagttgtgtgctgttcataccatgtctggaatactgttttcagttcagatcaacaattacaacacatatagtaacagtgacag

SEQ ID NO: 345634 - DNA, 395 bp, Homo sapiens
tcccgcctcgggctcccaaaatgctgggattacaggtgtgagccaccatgcccagcttagttgtattttaaatgggcctgtttgcagcattccctactccccttagtttacctggctcacaacctgtctttccatatcaaggcttctgtcacccctggcccatgtcagtgcatttgggcagcccacccagcatcatcacctcatgtcccagggaacttcctgttcctctcttccagctatttccttccctggcagttgagatagtctctacctttgacctactgttaagctcagaccttctgctctctagttacagcctctgtgctgccagattccctcgctcagttgctttctctagtttgggttttctcctttattcagatttccagctgttt

SEQ ID NO: 345635 - DNA, 383 bp, Homo sapiens
cctcccaaagtgctgggattacaggcataagccactgtgcccagcccagtgtccttatatctaactgtccactgaacacttggatgtgtcacaggcagctccaactctacatacctaagatatttccctctctcttcctgtgtctcccatctcagacaatggttctgccacccaccccatattcaaatctgaaacctgggattcacaggggactcctctcagagccctgatgatttctctgcacctctatgcctccatcactggcctaaagccaccagaatttctttcccgattactgcaccatcctcctccctggccccaaagcctccaaacctgccctactcaaaccccttctccaaaaccagactgatttctcaaattga

SEQ ID NO: 345636 - DNA, 742 bp, Homo sapiens
attgtgtatttttgctttcaattttttctttattacagtagtttattgtttactaatttattttttccctaagaaacagtttagctttatctgtttttgaactttataatgatggaattactcagcgtgtgttttttttcttttggtatctagctcttgttcaacattaagtttttaagatttatttgggagctaaatggtgagaacacatggacagatagaggggaacaacatacactggggcctttcagagggcagaggatgggaagagagagaggatcaggaaaaataactaatgggcactaggattaataactgggtaatgaagtaatccatacaacaaactcccacgacacaagttaaaaaaaaagcttcccatttatagattgctacttagaaggcagggatttgaactgggaggaatttaaaatgatcttgacctgttgtgttgtgaaaaggtttacaaatttcaggaaaatatacctcttctcaaatggattgggaattatgaggtcacagacatttctcaggattccgtaaaacatgtacctgtagcagagtattagaggagattgaagcaaaggggcaagcggtaacttcttgggggcgattaagtcattgtattatcatggtgggggcaggttatacagttgtttatatttgtcgaaagtcatcagcctgtatatttaaatcatgtgtatgtaaattacaatttaataaagttttaaaaatgaaaaaaaaa

SEQ ID NO: 345637 - DNA, 791 bp, Homo sapiens
aaatgcctcttattgtttacattatgaagtctcaacttggatggaagcccaactgcaacacggcctcctaaaatgagacgcaactgttcaactgaactgttctcaggactaaaaggctgtgtcaataagatacggggaatatttgttcttctgtgtgttccgatccttgtttttctttcccttcgttgatctcttgtttcacaacttccaacccaaatctgctcacagctactaacttggcttttaacatatgaaactttctaaaagtaaagtttcaaatggggaatgaagaggctcagaatacactaccccaaaacatgtcactcagaacacatcatccccaaatatgccactttggcatcagaattattttaaactaaaggcacataaaaacaggagatgcaagaagatcactctgaccttcactgttctttaaaagccagagatgaaattcccatgtgaaaggtgttctccctaaaccaagaagaaagtaacattctcatcacaaaggataggaagttgaggctgataggaatctatacaagcatcccttatgttcctaattacttatttacccagttatttaccctagcataagcccctttgccttgttacattttcacaattcagggcataaatgtttgactctagctgctgctttgtgtcttcacttccttatgaatgctctcctgccattaaaaaacttgcattaaataatttatatacttttctcctgttgatttgtcttatgtctatttaattctccaggcccaggcaacaaacaaacaaac

SEQ ID NO: 345638 - DNA, 1257 bp, Homo sapiens
gctcctccgtggctgccgtggtcggctggccgggcggctaggagttcccggaagtgcccgcgcagccggtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacagaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgtaaatgcacaatgtgactcattctcatacttttttgttcagctctgagcctcaaaagtgatttgtcagcagcgctggcatgcaggctttgcctggctgctatctctagaggcaagtctgccacgagagggcactgcaggcgaagcagttgtgcttgctcattgcctcagcccaagtgtactcaaagaaaagaggcagccagctgtgcgtgctgtacggaaagcctcccgccctccctgcagctccccgccctcagtggcccagggctttgttgaagtggaactccccacttccaacctggtatggctccttctgcgaagggaagctgatcccagcctcctgagctgaatccttcaaaggcacagcaggcagaatgagggccacaggcaggagtggtgtgggcacactgcttaggagtcaacatcttcatcattgggctttctttaaaacgtgcactttgtaatttgaaagagaattattaaagcatactgaaaaaaggaaattta

SEQ ID NO: 345639 - DNA, 1824 bp, Homo sapiens
gctcctccgtggctgccgtggtcggctggccgggcggctaggagttcccggaagtgcccgcgcagccggtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacagaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgtaaatgcacaatgtgactcattctcatacttttttgttcagctctgagcctcaaaagtgatttgtcagcagcgctggcatgcaggctttgcctggctgctatctctagaggcaagtctgccacgagagggcactgcaggcgaagcagttgtgcttgctcattgcctcagcccaagtgtactcaaagaaaagaggcagccagctgtgcgtgctgtacggaaagcctcccgccctccctgcagctccccgccctcagtggcccagggctttgttgaagtggaactccccacttccaacctggtatggctccttctgcgaagggaagctgatcccagcctcctgagctgaatccttcaaaggcacagcaggcagaatgagggccacaggcaggagtggtgtgggcacactgcttaggagtcaacatcttcatcattgggctttctttaaaacgtgcactttgtaatttgaaagagaattattaaagcatactgaaaaaaggaaatttaaaaaaaaaaaaaaaaaaaaaaaaaaagaaaaaaaaaaaaaaaaaacaaaaaaaaaacacaaaaaaaaaagaaaaaaacaaaaaacgaagagagagaagagaaagagaagagaaagaacatgaaaataagagcgacgagcacatcatcagacgacaatagaaacgacgcacggcgcgcgagcgcggcggcggcggcgggaggcgactcaggaattgaaagcgcgggcgcgaaggagcattgagacagaataagcagacggcaagacaaagggagaaagcgataaatcgaactcagcctgagatcgacggcgtagagacgcgtgtgacacacaagcgagagaacaaagaagctaagacagagcagaacgagcgaaacaggaagaagaagagagcagcaacgcgacacaaaggagatcagagacagaagttaatgcgacgagagatgagcaacaacgggtggcagaagcaagcaaaggcacgtggggacagcaagagcacgacgaagcgaaagggacaagtaacaagtcggattcacaggaagagagcggagacaggagtaggagaggag

SEQ ID NO: 345640 - DNA, 1207 bp, Homo sapiens
  misc_feature (1206)..(1206): n is a, c, g, or t
gctcctccgtggctgccgtggtcggctggccgggcggctaggagttcccggaagtgcccgcgcagccggtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacagaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgtaaatgcacaatgtgactcattctcatacttttttgttcagctctgagcctcaaaagtgatttgtcagcagcgctggcatgcaggctttgcctggctgctatctctagaggcaagtctgccacgagagggcactgcaggcgaagcagttgtgcttgctcattgcctcagcccaagtgtactcaaagaaaagaggcagccagctgtgcgtgctgtacggaaagcctcccgccctccctgcagctccccgccctcagtggcccagggctttgttgaagtggaactccccacttccaacctggtatggctccttctgcgaagggaagctgatcccagcctcctgagctgaatccttcaaaggcacagcaggcagaatgagggccacaggcaggagggggggggggggggggggggggagtcgagggcggcggcaggggggggggggtaagacgtgcnc

SEQ ID NO: 345641 - DNA, 923 bp, Homo sapiens
gctcctccgtggctgccgtggtcggctggccgggcggctaggagttcccggaagtgcccgcgcagccggtttccggtgcaggtggggaaaatggcggtgtctacagtgttctcgacttcgtcgctgaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgtaaatgcacaatgtgactcattctcatacttttttgttcagctctgagcctcaaaagtgatttgtcagcagcgctggcatgcaggctttgcctggctgctatctctagaggcaagtctgccacgagagggcactgcaggcgaagcagttgtgcttgctcattgcctcagcccaagtgtactcaaagaaaagaggcagccagctgtgcgtgctgtacggaaagcctcccgccctccctgcagctccccgccctcagtggcccagggctttgttgaagtggaactccccacttccaacctggtatggctccttctgcgaagggaagctgatcccagcctcctgagctgaatccttcaaaggcacagcaggcagaatgagggccacaggcaggagtggtgtgggcacactgcttaggagtcaacatcttcatcattgggctttctttaaaacgtgcactttgtaatttgaaagagaattattaaagcatactgaaaaaaggaaattta

SEQ ID NO: 345642 - DNA, 1225 bp, Homo sapiens
gctcctccgtggctgccgtggtcggctggccgggcggctaggagttcccggaagtgcccgcgcagccggtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgtaaatgcacaatgtgactcattctcatacttttttgttcagctctgagcctcaaaagtgatttgtcagcagcgctggcatgcaggctttgcctggctgctatctctagaggcaagtctgccacgagagggcactgcaggcgaagcagttgtgcttgctcattgcctcagcccaagtgtactcaaagaaaagaggcagccagctgtgcgtgctgtacggaaagcctcccgccctccctgcagctccccgccctcagtggcccagggctttgttgaagtggaactccccacttccaacctggtatggctccttctgcgaagggaagctgatcccagcctcctgagctgaatccttcaaaggcacagcaggcagaatgagggccacaggcaggagtggtgtgggcacactgcttaggagtcaacatcttcatcattgggctttctttaaaacgtgcactttgtaatttgaaagagaattattaaagcatactgaaaaaaggaaattta

SEQ ID NO: 345643 - DNA, 1027 bp, Homo sapiens
gctcctccgtggctgccgtggtcggctggccgggcggctaggagttcccggaagtgcccgcgcagccggtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacagaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgtaaatgcacaatgtgactcattctcatacttttttgttcagctctgagcctcaaaagtgatttgtcagcagcgctggcatgcaggctttgcctggctgctatctctagaggcaagtctgccacgagagggcactgcaggcgaagcagttgtgcttgctcattgcctcagcccaagtgtactcaaagaaaagaggcagccagctgtgcgtgctgtacggaaagcctcccgccctcccgtgcatctgtatccatcctaagacaggtagggaccgacc

SEQ ID NO: 345644 - DNA, 1147 bp, Homo sapiens
gggccaggggtcagcaaacttgttcataaaggaccagatagtaagtattttacttgtagtcatatggtctctgttgcaagtacccaattctgctgtcataacacaaaaggagcatgggtaatatgtaaaccattgggagcagctgttccaataaaacgacttgcaaatataggctcacacagtttgccaccccctggtataggctaacatcgtgtatatttagaagaaggatggagacagtctatatatccatctgtggttcttggccagtgtttcgagttttaagattctcatacctgagcattgactgactatggcataattttttctgcccactcttctcttgcaggaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgtaaatgcacaatgtgactcattctcatacttttttgttcagctctgagcctcaaaagtgatttgtcagcagcgctggcatgcaggctttgcctggctgctatctctagaggcaagtctgccacgagagggcactgcaggcgaagcagttgtgcttgctcattgcctcagcccaagtgtactcaaagaaaagaggcagccagctgtgcgtgctgtacggaaagcctcccgccctccctgcagctccccgccctcagtggcccagggctttgttgaagtggaactccccacttccaacctggtatggctccttctgcgaagggaagctgatcccagcctcctgagctgaatccttcaaaggcacagcaggcagaatgagggccacaggcaggagtggtgtgggcacactgcttaggagtcaacatcttcatcattgggctttctttaaaacgtgcactttgtaatttgaaagagaattattaaagcatactgaaaaaaggaaattta

SEQ ID NO: 345645 - DNA, 1059 bp, Homo sapiens
  misc_feature (771)..(771): n is a, c, g, or t
  misc_feature (874)..(874): n is a, c, g, or t
  misc_feature (948)..(948): n is a, c, g, or t
gctcctccgtggctgccgtggtcggctggccgggcggctaggagttcccggaagtgcccgcgcagccggtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacagaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgccccctggggccctgcccnacagcatcatgatggggaaactccccctgggggtcgtctccccttatgtgaagatgagttcggggggctacacggacccctgaaattctacgccaccagctantgcacagcctacggtcgggaggatttcaagccccgtgtgggcagtcacgtaggcaccggctacaaatcaaattnccagcccgtggtctcatgccaaagccagtctggaggccttagacaacccggacaggcaggaaaacaagcccaggaccatttacagactgtggccagcagagactatcgccc

SEQ ID NO: 345646 - DNA, 766 bp, Homo sapiens
  misc_feature (478)..(478): n is a, c, g, or t
  misc_feature (581)..(581): n is a, c, g, or t
  misc_feature (655)..(655): n is a, c, g, or t
gctcctccgtggctgccgtggtcggctggccgggcggctaggagttcccggaagtgcccgcgcagccggtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacaccccctggggccctgcccnacagcatcatgatggggaaactccccctgggggtcgtctccccttatgtgaagatgagttcggggggctacacggacccctgaaattctacgccaccagctantgcacagcctacggtcgggaggatttcaagccccgtgtgggcagtcacgtaggcaccggctacaaatcaaattnccagcccgtggtctcatgccaaagccagtctggaggccttagacaacccggacaggcaggaaaacaagcccaggaccatttacagactgtggccagcagagactatcgccc

SEQ ID NO: 345647 - DNA, 877 bp, Homo sapiens
gctcctccgtggctgccgtggtcggctggccgggcggctaggagttcccggaagtgcccgcgcagccggtttccggtgcaggtggggaaaatggcggtgtctacagtgttctcgacttcgtcgctgggaattggtttgtttgttgctgttggctcagtgtctccatcggggaaggaggatctggggtttcctactccaccatcttcacctcttgctgaggtcaccaccttgacatcatatcttgataagttgtccacttctctggattgggagcctttgggggattagggatcatgctgtctctgtgtgctcaggatttgacacagatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacagaagctaacccagccaaaaaaaaaaaaaaaaaaaaaaaaaaattttgggggcgcccggcccggaaattttaacctctcttggcgccggccccgggaggaacggccacggtccaggaacccggccggctgggggtttcccaaaaacccggggccgggtcgcaccccggggtcgggccggttccggccgctatccccccccccgcgggggggacgcaacc

SEQ ID NO: 345648 - DNA, 819 bp, Homo sapiens
gctcctccgtggctgccgtggtcggctggccgggcggctaggagttcccggaagtgcccgcgcagccggtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccacttctctaggcacttaactttccttccatttcatttccatttccttccatttcactgagcacagccaggtccagagggtgcaaagacaagtaagaagggggtcccacccttgaacttatgaagagggggtgcagacagatcaatgcaggaatcagtgatgacaatcccggggctctgcgcgcaccaggaagcaccagcaagcgtgcctgacagccagcaggagctcaggacacaacaggacacgacaggctggaaggacccagcagacaggactggagctggtctctgccagagccacaggaggaggtgtttgcctaagaaggggtcagaacatcgttgcccctcccccacctccgtgggaactggagcggccactgtgctgagtctgctgtgcgggcggaagctctgctcctcccctctgagcctcagggtttaggccagaggacaacaaacggcccttccagctcagactctctgttgctcctccaggacaccgccctcccctcttttcagtctcagttcaaacgtcacctgctcaaggc

SEQ ID NO: 345649 - DNA, 383 bp, Homo sapiens
aggagtcttggtgtcacttctcttttattagacacagccttctcaacctctttttctttttttctttcttgtttttagtctttttgctaaagaacatctgcagcacatgacagaaaagcagctgaacctctatgaccgcctgattaacgagcctagtaatgactgggatatttactactgggccacaggtactgggtatgataagcagcataatgtgaaaataggacagtttaggctgatttgagtctagaattgtatcctagataatttttttctttcttttttttttttgagactgagtttcactctcgttgcccaggctggagtgcaatggcatgatctcggctcactgcaacctctaccttccaggttcaagcgattct

SEQ ID NO: 345650 - DNA, 2023 bp, Homo sapiens
gctcctccgtggctgccgtggtcggctggccgggcggctaggagttcccggaagtgcccgcgcagccggtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacagaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgtaaatgcacaatgtgactcattctcatacttttttgttcagctctgagcctcaaaagtgatttgtcagcagcgctggcatgcaggctttgcctggctgctatctctagaggcaagtctgccacgagagggcactgcaggcgaagcagttgtgcttgctcattgcctcagcccaagtgtactcaaagaaaagaggcagccagctgtgcgtgctgtacggaaagcctcccgccctccctgcagctccccgccctcagtggcccagggctttgttgaagtggaactccccacttccaacctggtatggctccttctgcgaagggaagctgatcccagcctcctgagctgaatccttcaaaggcacagcaggcagaatgagggccacaggcaggagtggtgtgggcacactgcttaggagtcaacatcttcatcattgggctttctttaaaacgtgcactttgtaatttgaaagagaattattaaagcatactgaaaaaaggaaatttacaatttcccagccctcacaattaattttaattttgtctattttcatataacccatagtcatgtttatagagttttacaagttcacaattacaggttttattttcatgtagcactatagaaaactttccccctcattcctacagtcttcacaattagttgactaaataataatacataagaaataatatattagaatgaattagttagaagtgtttttaaaagctctagggctgtgtgacttctgtgttgctagtggtgccctccctggaggggttttgccctcagagctgtaatctaggcagtagaatcagtcacccagactggaccaggtgcatctaaaggtgttgactagaagaaggtcggccagatttgatgagcaggtggttggtgattataggagccgcacacagggactacacacgcacatgtttccagcattgttgagctccagggttcctacagagccacctcatggttcctgcctgctcttcagtatccctggtggctcaggagggaagggaagagatctagcctttacgtaatcacagttaagcctcacagcactctagactagtggtgttacctgtattttatacataagaaagtgggctcagagagaggaagtaatttgtccaaggtcaggtagctattgagtcgaaaaagcagaatttagtatagctcagtctgcctccaaagctcttgaactttctactagaacacactgccttactgctggaaatttaatagaagtctctgtttgggaaag

SEQ ID NO: 345651 - DNA, 1457 bp, Homo sapiens
gctcctccgtggctgccgtggtcggctggccgggcggctaggagttcccggaagtgcccgcgcagccggtttccggtgcaggtggggaaaatggcggtgtctacagtgttctcgacttcgtcgctgggaattggtttgtttgttgctgttggctcagtgtctccatcggggaaggaggatctggggtttcctactccaccatcttcacctcttgctgaggtcaccaccttgacatcatatcttgataagttgtccacttctctggattgggagcctttgggggattagggatcatgctgtctctgtgtgctcaggatttgacacagatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacagaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgtaaatgcacaatgtgactcattctcatacttttttgttcagctctgagcctcaaaagtgatttgtcagcagcgctggcatgcaggctttgcctggctgctatctctagaggcaagtctgccacgagagggcactgcaggcgaagcagttgtgcttgctcattgcctcagcccaagtgtactcaaagaaaagaggcagccagctgtgcgtgctgtacggaaagcctcccgccctccctgcagctccccgccctcagtggcccagggctttgttgaagtggaactccccacttccaacctggtatggctccttctgcgaagggaagctgatcccagcctcctgagctgaatccttcaaaggcacagcaggcagaatgagggccacaggcaggagtggtgtgggcacactgcttaggagtcaacatcttcatcattgggctttctttaaaacgtgcactttgtaatttgaaagagaattattaaagcatactgaaaaaaggaaattta

SEQ ID NO: 345652 - DNA, 1614 bp, Homo sapiens
gctcctccgtggctgccgtggtcggctggccgggcggctaggagttcccggaagtgcccgcgcagccggtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacagaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgtaaatgcacaatgtgactcattctcatacttttttgttcagctctgagcctcaaaagtgatttgtcagcagcgctggcatgcaggctttgcctggctgctatctctagaggcaagtctgccacgagagggcactgcaggcgaagcagttgtgcttgctcattgcctcagcccaagtgtactcaaagaaaagaggcagccagctgtgcgtgctgtacggaaagcctcccgccctccctgcagctccccgccctcagtggcccagggctttgttgaagtggaactccccacttccaacctggtatggctccttctgcgaagggaagctgatcccagcctcctgagctgaatccttcaaaggcacagcaggcagaatgagggccacaggcaggagtggtgtgggcacactgcttaggagtcaacatcttcatcattgggctttctttaaaacgtgcactttgtaatttgaaagagaattattaaagcatactgaaaaaaggaaatttaaaaaaaaaaaaaaaaaaaaaaaaaaaactttttgggccgcggccttggggccccgaggaagaaggctttttaaaaccacttcgcgttgtggggggccgcgcggccccagtaggtgtaaggtggcaactgggggtcatgagagcgtggtcccctcaaggaaatcctggcgccaggaacttaagtggtgggtttctctccaccaattaaaaaaacgcgccgcggggggaacaccggaggtttttggaacaaattccccagaagggagtctcgagaggcccaataacgggctttcatacccaccgggagaccccagagggaagccgaataacaaattaacacggccgccggagaaaaagg

SEQ ID NO: 345653 - DNA, 1149 bp, Homo sapiens
gctcctccgtggctgccgtggtcggctggccgggcggctaggagttcccggaagtgcccgcgcagccggtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacagaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgtaaatgcacaatgtgactcattctcatacttttttgttcagctctgagcctcaaaagtgatttgtcagcagcgctggcatgcaggctttgcctggctgctatctctagaggcaagtctgccacgagagggcactgcaggcgaagcagttgtgcttgctcattgcctcagcccaagtgtactcaaagaaaagaggcagccagctgtgcgtgctgtacggaaagcctcccgccctccctgaatccttcaaaggcacagcaggcagaatgagggccacaggcaggagtggtgtgggcacactgcttaggagtcaacatcttcatcattgggctttctttaaaacgtgcactttgtaatttgaaagagaattattaaagcatactgaaaaaaggaaattta

SEQ ID NO: 345654 - DNA, 1144 bp, Homo sapiens
gctcctccgtggctgccgtggtcggctggccgggcggctaggagttcccggaagtgcccgcgcagccggtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcgaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgtaaatgcacaatgtgactcattctcatacttttttgttcagctctgagcctcaaaagtgatttgtcagcagcgctggcatgcaggctttgcctggctgctatctctagaggcaagtctgccacgagagggcactgcaggcgaagcagttgtgcttgctcattgcctcagcccaagtgtactcaaagaaaagaggcagccagctgtgcgtgctgtacggaaagcctcccgccctccctgcagctccccgccctcagtggcccagggctttgttgaagtggaactccccacttccaacctggtatggctccttctgcgaagggaagctgatcccagcctcctgagctgaatccttcaaaggcacagcaggcagaatgagggccacaggcaggagtggtgtgggcacactgcttaggagtcaacatcttcatcattgggctttctttaaaacgtgcactttgtaatttgaaagagaattattaaagcatactgaaaaaaggaaattta

SEQ ID NO: 345655 - DNA, 1160 bp, Homo sapiens
  misc_feature (1102)..(1102): n is a, c, g, or t
gctcctccgtggctgccgtggtcggctggccgggcggctaggagttcccggaagtgcccgcgcagccggtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacaggtgactgggtacctggatatgtgatcgagtattcttctgggtgtttctatgaggatgtttttggatgaaattggcatttaaattggtaaactgagtaaagcagtctgtccccctaaccggggtgggcttcatgtaatcagctcaaggtttgaatacaacaaaaagacttacactctcgcaagtgaaaggcaattctttctgcctggtagccttcaaactgagacacaggcttttatcctgccttcagattcgcctgggaacactggctcttcctgagtctcaagcctgctggccttgagacaagaactacatcagctctctcagttctcaagcctttggacttactctggaactaagcatcagtctcttgggtcgtcagcttgcaaccaatcatcctgaagatcttgggacttgccagccttcatagtcacgtgggccaatcccttttttttttttttttttgagatggagtcttgctctgtcgcccagtctggagtgaaatggcacaatatcagctcactgcaaacttcacctcccaggctcaagcgatcctcccacctcagcctcccaagtagctgggactgcaggcgtgcgccaccatgcctggctaattaaaaaaaaaatttttttttgtagagacgnagtttcactgtgttgctcaggctggtcttgaactcctgagctcaagcaaccctccact

SEQ ID NO: 345656 - DNA, 656 bp, Homo sapiens
  misc_feature (628)..(629): n is a, c, g, or t
  misc_feature (631)..(631): n is a, c, g, or t
  misc_feature (633)..(633): n is a, c, g, or t
  misc_feature (636)..(638): n is a, c, g, or t
aactagcgcttatgtattaacccctacactcatctcaacccctgacaaacacatacctaccccttcctgtactatccctatgaggcataattattacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacctcgtgatcctcgaggatcagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcagctttcggacagtcctttctctagcccgacagnncncnctnnnacaggacatcgtgatcct

SEQ ID NO: 345657 - DNA, 309 bp, Homo sapiens
aacgggtgatgcggttgggtctggatgaattgtctcgttgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatgggtagctcatgtaagtggagtcatgaagtatttggcctgttgtgactgccttatttcacatggcaca

SEQ ID NO: 345658 - DNA, 4576 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggtgttctcaagcttcatccgtgtggtggcgtgtgtcagagcttccttccttttgaaagctgaattccattgcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345659 - DNA, 3400 bp, Homo sapiens
gtcagctgggttgaaatcggcgagggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345660 - DNA, 4541 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagaggtggttaatggaatgaagggttgcctgtcctgtagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345661 - DNA, 3056 bp, Homo sapiens
cgagctcggtacccctccaagacgactgttaattttacttgtcagatagtccaaacacagcgtccagatatccaaacaagagaagtaaccttcatgagtaggctgatgaaatgtgaacttgaactaaagtgtcaaaaactccaccacagggaactgggagtaagactcgattcttcttaggtgaacactcaccaagagccgaagaaagtcagtaaacttctcgatatagctctcatcgagctcttctagcctgctcttcactgtgtgggcattgttatccttggtgattttctgcaggaggtagaaagtctgctggaacatacgcagtaaatactcctcccattccataggcacacagttcttggacatgagttcattgatgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345662 - DNA, 3327 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345663 - DNA, 2468 bp, Homo sapiens
ccccccgtgttgattcggccgagggtgatggagctcctgtcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345664 - DNA, 4683 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaaaaaaaaaaaaaaaattgggggaataaatggggagggcggacaaagacgtactgaaatgggcacagggcctataactgttaccggaccaagtttttggtacaacggggtaaatcggcgggtcccctatagtgagtcgaataattccaatagcccggtaacctggttagagtcgaaaag

SEQ ID NO: 345665 - DNA, 2341 bp, Homo sapiens
aaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccgttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345666 - DNA, 7128 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggtgaggagagaaagaggccgggctaagaggagggcagagtgggcacgcaagcctggcacctgtgcagcaaggagggggcacattgaggcctctgggcgtggtctgtgcccaccctgcagcttggcggcagctcacgagatgcctgctgacctggtgctgtagcctgattgaggggcacagccttttccccagtcttggtgtctgtagcacgtatgttcttagtctcagccatggaggtcccgagttcctggctctgcagcccctccatttgtcttggcatctttgttcatacccaggaccctgccgttctccctcctgggtgatgagccccggtggggccagcattggagtgtgcccaggcttgcattcaggctgagatggttggtgcttgggagctgcacttctgggtccccagggttagaggtgggacccaggttccccggctgtcttgggctctttccagaccagccccagctcagcttgggctgagttgctgccaggtcctgggaggagccctcctagtactcaccctcttgtcccactgctgccacctgtgcagggactgtcaggtgggctgtccccacccgtgcagcacctcggtgggagctgggtgctgctggctcttggtgtccatgaggccatcttgttggagcctgacagtgcctgggacctccttccccatggggctcacctgttctcttcttcctgtgtcaggtgaccaggcctctctcttgcctgataggaacttctgggaacttttccttgtaccgttttatacttgatgaaattaggaaaagaaatcgctttctccctggtcctcttggggttcttgacctgagtcctctgtgaagcagcttgtccacggctccaccgtagtgctcagatgcacacactgctctcactggtacaaacctggccgcctgctttcctcatttgccacgtgtggcagggaagcttttgcttagactcatcctgttctcctttgtcttggggtcttccttttcttgggacttgttctctcctaagcctcttccagttcacttcagcccctggatatgttttttcctttttctagaggccagatcctaatacttaatgatcagcttctaacgacatcaatatcagtcaactttttgatttaaagctgtggtttcaaaatctagttataggccaggcgcggtgtctcacacctgtaatctcagcactttgggaggccaaggcgggcggatcacttgaggttagggggtttgagaccagcctggccaacatggcgaaaccctgtctctactaaaaataaaaaaaattagtcaggtgtggtggcacacgcctgtaatcccagctgcttgggaggctgaggcacaagaatctcttgaacccgggaggcagaggttgcagtgagcggaggttgtgccactgcactccagcctgggcggcagagtgggactttgtctcaaaaaaaaaaatctagttatatcagaagcacctggggtacttattaaaaatggagaaacagacttctgtgttctacccaggaaattctggtttggcatttgggagccactgatttaaaagacatcccttagttggttttttgagggtaaaataaaagaatcaccaccttccattcagtcacgcactgtgtgtttgaagccagctgcttctcaagccccgggccaggaactggggcaccagtcccagccttcaccaagtctttcatggtagacaggccaatacagcaccctctgtggaccacatagtgccaagcatgtgacatgtcttggctcgagtaagccttctaacaagcctctgaagtgtgggtcctgttactcccccatttcacagatggtgggggctcagaaggtgagcagttcacagaacttggaagtggtagagctgcgaagcaggaggcagacctgggtgttctggccccagagcctgcacacactccccagaagcagattgctcaggacagaggcgctgagctggctgctggggccaggaaataggaggcatctgtgcagactttgggaagaggcaggctttgaatggagttctggaagaggaatagtggttgggcaggaaaatgaacttggtcctgctcatggctctgctggggcttgctgggcctgtttgagtcctcaccgggacctacactgaaaaaaaaagcagggtctcaccgtgtgcatgatggcggaggtcagggcctcacttctggcccagggccttccatggcccacgctgcgcccagtgggacaggccttgggactgtgtttgctgctgctcgggtggctctcgaggggcaggggcggcctggagccccgtgggtaaaggttctgcagacattgctcggtgtgcgcgtcacctcaaggggccatggtgaagaagagggctgtcaccacagccatgtctgcgtttgaggggccggactcaggagcaagtgtgctggtctcttcagtgtgagctggggccagcttcttcatggtgcagcgctttggtctttctgtccttagactagtggttctggtagggcttggtggcagccttgtggtgaggactcagtgagttgatgtctgtatgttgattgcagcagtgtctggcacccgagaggccctagggacgtattcctcttgttctttttctcccacagcgcctggcacagagtctctgtgacacgcagtgcaacagtgaatagaagttttgagttttagaaagtgctcccctatcttcagtgcacactctgggatggaagtagctgttggggtctggtgggtgggtgacctggtgtgttgttggctgcagctatgcccctgccttccaggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345667 - DNA, 1388 bp, Homo sapiens
aggaacaactggctaagtacgaggctgggtgtttaatcggccgaggaacatgtataccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345668 - DNA, 2873 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagagctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345669 - DNA, 1015 bp, Homo sapiens
ggaacccaaggagtgtgaccaaggcccatctgggagacatctgtggtggaaggtagggctggcttggtggcagccttgtggtgaggactcagtgagttgatgtctgtatgttgattgcagcagtgtctggcacccgagaggccctagggacgtattcctcttgttctttttctcccacagcgcctggcacagagtctctgtgacacgcagtgcaacagtgaatagaagttttgagttttagaaagtgctcccctatcttcagtgcacactctgggatggaagtagctgttggggtctggtgggtgggtgacctggtgtgttgttggctgcagctatgcccctgccttccaggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345670 - DNA, 2763 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgtaagtctagagtttgatgtttgtgcatttttaggaaagaccttgcccccaatctccaaataatttgattgagaaaaaggaacagtagtggctgccatgaatcagggaaaaactcttaaactgcaaacctagaaagagagagagatttttttgactatatgtctggggcagaggcggttggagaaagtggaattaggtaagtgagagctgggatggagattctatggagtaggcatttcaggaggaaagaacagtacaggctgagacagtcacacaggcaggaggtggctactccatgtagtgcaagaagagactggataggtgtgttgggactaatg

SEQ ID NO: 345671 - DNA, 2456 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcatcactaggatgggccgagctcg

SEQ ID NO: 345672 - DNA, 1893 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttactaaaatgagtcagtgcaccagctccaccattcctagctcaagtcaagagaaagaccctcaaatttagacagagacaacgcgattg

SEQ ID NO: 345673 - DNA, 1301 bp, Homo sapiens
  misc_feature (1184)..(1184): n is a, c, g, or t
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacagagatgggccaggcactccaaagccagggaacagatatactcactctccacatncaaggatgggaattgctgattcaacagtttggctgaactgggactctgcaacaggttactcagtaagtcaccactttctcctgagtcgggatggtgtggagtgcagcagtaacctgt

SEQ ID NO: 345674 - DNA, 195 bp, Homo sapiens
atgacctgaactgtgcgagcgggacgtgtccgaagcccaagaaccagctcatctgagccgccccctccccggccagcatgggtaagtggaattggagcccccttccctcctggggtgccctaccggaagggtgggaatgggccccggggctgctgagccatcgctgctctccccatggcggggagaggcgcgtgc

SEQ ID NO: 345675 - DNA, 664 bp, Homo sapiens
agaggtgttgaatcgaatccagttcagatacaaccaagcccagctggaggagttggatgatgagactctggatgacgatgtaagcggcatgccctgattgattttttgtcgctgtcatgttgtgacatcaatcagaatggggacctggaacccagagccctctgctccgaagactgttctgaaaccagagtagtcttctggtttgagtcgtacatttgaaatttttaatctcctgctggtcccttttggcttattaaccataaaaaatgttttacaggcttttttatctatgtggactagagatgtaagtagagaaaccatatgcacaatgaaaaacggtttagtgagaactctgtatcctctctgtctcccctgccttgcaccctcacctctgctccccaacctgggcagcagtaacagctagctggatgcttgtggagaccgttagcaagatactgaaccgataaggctagaatgaaaggaagtctgtttggagtacattatgcaaacttctgcttcttaaaatcagccttgaatttattgatgctgatgtgcccaacattaataaggaaaatgtctttaaggaaacaattccagtgtttttttttaaaccattaggcactttaaaatttttcaaataactgctgctcttctcaaagtaaga

SEQ ID NO: 345676 - DNA, 5727 bp, Homo sapiens
attgaatttaagttctaaggaggtggctgggtttcttattgtcaccttttgtcttgtctcatttagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggtgaggagagaaagaggccgggctaagaggagggcagagtgggcacgcaagcctggcacctgtgcagcaaggagggggcacattgaggcctctgggcgtggtctgtgcccaccctgcagcttggcggcagctcacgagatgcctgctgacctggtgctgtagcctgattgaggggcacagccttttccccagtcttggtgtctgtagcacgtatgttcttagtctcagccatggaggtcccgagttcctggctctgcagcccctccatttgtcttggcatctttgttcatacccaggaccctgccgttctccctcctgggtgatgagccccggtggggccagcattggagtgtgcccaggcttgcattcaggctgagatggttggtgcttgggagctgcacttctgggtccccagggttagaggtgggacccaggttccccggctgtcttgggctctttccagaccagccccagctcagcttgggctgagttgctgccaggtcctgggaggagccctcctagtactcaccctcttgtcccactgctgccacctgtgcagggactgtcaggtgggctgtccccacccgtgcagcacctcggtgggagctgggtgctgctggctcttggtgtccatgaggccatcttgttggagcctgacagtgcctgggacctccttccccatggggctcacctgttctcttcttcctgtgtcaggtgaccaggcctctctcttgcctgataggaacttctgggaacttttccttgtaccgttttatacttgatgaaattaggaaaagaaatcgctttctccctggtcctcttggggttcttgacctgagtcctctgtgaagcagcttgtccacggctccaccgtagtgctcagatgcacacactgctctcactggtacaaacctggccgcctgctttcctcatttgccacgtgtggcagggaagcttttgcttagactcatcctgttctcctttgtcttggggtcttccttttcttgggacttgttctctcctaagcctcttccagttcacttcagcccctggatatgttttttcctttttctagaggccagatcctaatacttaatgatcagcttctaacgacatcaatatcagtcaactttttgatttaaagctgtggtttcaaaatctagttataggccaggcgcggtgtctcacacctgtaatctcagcactttgggaggccaaggcgggcggatcacttgaggttagggggtttgagaccagcctggccaacatggcgaaaccctgtctctactaaaaataaaaaaaattagtcaggtgtggtggcacacgcctgtaatcccagctgcttgggaggctgaggcacaagaatctcttgaacccgggaggcagaggttgcagtgagcggaggttgtgccactgcactccagcctgggcggcagagtgggactttgtctcaaaaaaaaaaatctagttatatcagaagcacctggggtacttattaaaaatggagaaacagacttctgtgttctacccaggaaattctggtttggcatttgggagccactgatttaaaagacatcccttagttggttttttgagggtaaaataaaagaatcaccaccttccattcagtcacgcactgtgtgtttgaagccagctgcttctcaagccccgggccaggaactggggcaccagtcccagccttcaccaagtctttcatggtagacaggccaatacagcaccctctgtggaccacatagtgccaagcatgtgacatgtcttggctcgagtaagccttctaacaagcctctgaagtgtgggtcctgttactcccccatttcacagatggtgggggctcagaaggtgagcagttcacagaacttggaagtggtagagctgcgaagcaggaggcagacctgggtgttctggccccagagcctgcacacactccccagaagcagattgctcaggacagaggcgctgagctggctgctggggccaggaaataggaggcatctgtgcagactttgggaagaggcaggctttgaatggagttctggaagaggaatagtggttgggcaggaaaatgaacttggtcctgctcatggctctgctggggcttgctgggcctgtttgagtcctcaccgggacctacactgaaaaaaaaagcagggtctcaccgtgtgcatgatggcggaggtcagggcctcacttctggcccagggccttccatggcccacgctgcgcccagtgggacaggccttgggactgtgtttgctgctgctcgggtggctctcgaggggcaggggcggcctggagccccgtgggtaaaggttctgcagacattgctcggtgtgcgcgtcacctcaaggggccatggtgaagaagagggctgtcaccacagccatgtctgcgtttgaggggccggactcaggagcaagtgtgctggtctcttcagtgtgagctggggccagcttcttcatggtgcagcgctttggtctttctgtccttagactagtggttctggtagggcttggtggcagccttgtggtgaggactcagtgagttgatgtctgtatgttgattgcagcagtgtctggcacccgagaggccctagggacgtattcctcttgttctttttctcccacagcgcctggcacagagtctctgtgacacgcagtgcaacagtgaatagaagttttgagttttagaaagtgctcccctatcttcagtgcacactctgggatggaagtagctgttggggtctggtgggtgggtgacctggtgtgttgttggctgcagctatgcccctgccttccaggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345677 - DNA, 4506 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345678 - DNA, 3239 bp, Homo sapiens
gtacggggctggcgttaattgttatgaatttgtcgttcgctttacatggacatgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345679 - DNA, 4761 bp, Homo sapiens
gtctcatgtctatctcttcatatgttaatttaaaaatctagctgcttgtatcaactatcaaatatcagttgttttgactttaatcataatgtagtcacagacaactttgttgtggcttccatttggatggtatagaaatgtcattatggattgtctatgtactgatgttgttacgtgtaacttttgtgctcttggttttacattttaatcctgtgcttcctattgccctgtgaaagctgagaggtgcctgggagcagaaaggtgacataaataatgctgtgtgcttgcttcctggctctgggtcccctaccactaattctaaacagctcagtccattctcagttgtttaggagctgctaaccagatccttggcttctctttccctctactgccttttcccctaactttctactgttcattagcacctgtaccagaaggtgggcaagggaaagaaaatgaggtgaaataaaatctgtagttttagctactgaacagccttgtttgtatttttaaaaaattgggttagatactaaagtaaaattgagattgttctgtatttagcccatggctttttttttttttttttttttttttaaatgggtagtagggaattgagtgcaccttcctaaagaacagtcagctgggtggtgactttgaatatccatgtaaaactatcatgcggtacataagtgagtgaggaaggagttcctactcttgagtattagtgattgatgacaccagagagaagtgtctttgtatgttcctgtctctaaaaacagttgattttagtgccttactgtttttcgagtacttggccccatgatccacagagacagccattctctttatcaaaacaaattaatatgtattttttaaaaagctgcaaataagctcggccgcatagaggtcaggcaggcaggctggccaccctcagggagataggtcccaggagcaacatgggacattttatttccgggccagttttgcttttctgagtagtagttttctctgcttttattatttcacatatctctgttttgaaaaatagcttttgcagtaatgagcttcagaattgcttttagccattatttcattttcagctaaggcctagtatgtctttacctttttgtgttggtctctgaaatgtgatttatgaaggtatggccatctcattttctaatcaccttttggtatttaggggcttaaaatgacagtttctgaaatgtgagagtgatgatgtgctgtgtatttaataacagagatctcttatccttgcagctgtgacccatactcttctgtgaaatgattttgtgaatacaaatgagttggggattcactgtgaagtgaaaagaaagagcactggattgggagtggatgatagtcctgttctgccatgagttggctgagtgactttgggctggtcactttacctctctgggcttcatctgcaaaacggaagcatcagactaaagtccctgaggcttgcccagttctaatagccttcctcccttatatttgaaatcacttttagagtattgggttgtgctgtgtttaattagcaccaggaaccaaagggggaaaaatggccattatgttgcaagcctgagtacatcttacctggatgccatgcccttcgtagcctggttttgtttttgtgtcttagcaccattcactttagtatttggcctcccggaaagaaaaccagccttctagacttgccagattgaaatgacacagtgatctgcccatcaactttttatcatttcccttcactttaattgggtcacaacacaaatgacttagaaaatgtgagcgcactagattataagaagccttagcagacagtgtctgaggattaaagttgcttttctgctatgtttcaggtggttaatggaatgaagggttgcctgtcctgtagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345680 - DNA, 4442 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345681 - DNA, 4485 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcggaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345682 - DNA, 2372 bp, Homo sapiens
taaggggggccggggccgagcggccgaggacgtaagcaccggcagggcggtgacaccggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345683 - DNA, 1757 bp, Homo sapiens
atgttgtgctcccgcggtgttgcgctcccgccggtgtgcgctcccgcccgttgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345684 - DNA, 6864 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggctttcggacagtcctttctccagcccgacatccacctttttaaacaaaatctcttctacttggagactctcaacaccaagcagaagctgtaccacaagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggtgaggagagaaagaggccgggctaagaggagggcagagtgggcacgcaagcctggcacctgtgcagcaaggagggggcacattgaggcctctgggcgtggtctgtgcccaccctgcagcttggcggcagctcacgagatgcctgctgacctggtgctgtagcctgattgaggggcacagccttttccccagtcttggtgtctgtagcacgtatgttcttagtctcagccatggaggtcccgagttcctggctctgcagcccctccatttgtcttggcatctttgttcatacccaggaccctgccgttctccctcctgggtgatgagccccggtggggccagcattggagtgtgcccaggcttgcattcaggctgagatggttggtgcttgggagctgcacttctgggtccccagggttagaggtgggacccaggttccccggctgtcttgggctctttccagaccagccccagctcagcttgggctgagttgctgccaggtcctgggaggagccctcctagtactcaccctcttgtcccactgctgccacctgtgcagggactgtcaggtgggctgtccccacccgtgcagcacctcggtgggagctgggtgctgctggctcttggtgtccatgaggccatcttgttggagcctgacagtgcctgggacctccttccccatggggctcacctgttctcttcttcctgtgtcaggtgaccaggcctctctcttgcctgataggaacttctgggaacttttccttgtaccgttttatacttgatgaaattaggaaaagaaatcgctttctccctggtcctcttggggttcttgacctgagtcctctgtgaagcagcttgtccacggctccaccgtagtgctcagatgcacacactgctctcactggtacaaacctggccgcctgctttcctcatttgccacgtgtggcagggaagcttttgcttagactcatcctgttctcctttgtcttggggtcttccttttcttgggacttgttctctcctaagcctcttccagttcacttcagcccctggatatgttttttcctttttctagaggccagatcctaatacttaatgatcagcttctaacgacatcaatatcagtcaactttttgatttaaagctgtggtttcaaaatctagttataggccaggcgcggtgtctcacacctgtaatctcagcactttgggaggccaaggcgggcggatcacttgaggttagggggtttgagaccagcctggccaacatggcgaaaccctgtctctactaaaaataaaaaaaattagtcaggtgtggtggcacacgcctgtaatcccagctgcttgggaggctgaggcacaagaatctcttgaacccgggaggcagaggttgcagtgagcggaggttgtgccactgcactccagcctgggcggcagagtgggactttgtctcaaaaaaaaaaatctagttatatcagaagcacctggggtacttattaaaaatggagaaacagacttctgtgttctacccaggaaattctggtttggcatttgggagccactgatttaaaagacatcccttagttggttttttgagggtaaaataaaagaatcaccaccttccattcagtcacgcactgtgtgtttgaagccagctgcttctcaagccccgggccaggaactggggcaccagtcccagccttcaccaagtctttcatggtagacaggccaatacagcaccctctgtggaccacatagtgccaagcatgtgacatgtcttggctcgagtaagccttctaacaagcctctgaagtgtgggtcctgttactcccccatttcacagatggtgggggctcagaaggtgagcagttcacagaacttggaagtggtagagctgcgaagcaggaggcagacctgggtgttctggccccagagcctgcacacactccccagaagcagattgctcaggacagaggcgctgagctggctgctggggccaggaaataggaggcatctgtgcagactttgggaagaggcaggctttgaatggagttctggaagaggaatagtggttgggcaggaaaatgaacttggtcctgctcatggctctgctggggcttgctgggcctgtttgagtcctcaccgggacctacactgaaaaaaaaagcagggtctcaccgtgtgcatgatggcggaggtcagggcctcacttctggcccagggccttccatggcccacgctgcgcccagtgggacaggccttgggactgtgtttgctgctgctcgggtggctctcgaggggcaggggcggcctggagccccgtgggtaaaggttctgcagacattgctcggtgtgcgcgtcacctcaaggggccatggtgaagaagagggctgtcaccacagccatgtctgcgtttgaggggccggactcaggagcaagtgtgctggtctcttcagtgtgagctggggccagcttcttcatggtgcagcgctttggtctttctgtccttagactagtggttctggtagggcttggtggcagccttgtggtgaggactcagtgagttgatgtctgtatgttgattgcagcagtgtctggcacccgagaggccctagggacgtattcctcttgttctttttctcccacagcgcctggcacagagtctctgtgacacgcagtgcaacagtgaatagaagttttgagttttagaaagtgctcccctatcttcagtgcacactctgggatggaagtagctgttggggtctggtgggtgggtgacctggtgtgttgttggctgcagctatgcccctgccttccaggacctgccctcattcacccagaatgtgcacaggctggtcaacgacctgcgctactacagactctgcaacgacagcctgccccctggcactgtgaagctctaggcctctctcttgcctgataggaacttctgggaacttttccttgtaccgttttatacttgatgaaattaggaaaagaaatcgctttctccctggtcctcttgg

SEQ ID NO: 345685 - DNA, 3392 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacaccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcagatgtgactgatgagatgctgagcttcttcctcactctgtttcgaggccttagagtacagatgggtgtgcctttcactgagcaaatcatacagactttcctcaacatgtttaccagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgagcgtccctccttgatggaagcgtcgcgcatggtaccgagctac

SEQ ID NO: 345686 - DNA, 2342 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacagaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaa

SEQ ID NO: 345687 - DNA, 2915 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataagagaatgagcagcagtggcccgtgcgctccatcaaccacgccagcctcatctctgcactctcccgggactatcgcaacctgaagcccagtgctgttgccccacagagaaagatgccactggatgacatctttcactcagcattgtttgtgagtcatcatgtttttaggatagcagtagtagttcattgatttttcagtg

SEQ ID NO: 345688 - DNA, 2645 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattacaacagtttatagtcacttcagggtcaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggttggtcaaagtcactctgtacggatctcagataaaattgtacaacattgaaactgctgtgccatcagtattgaaacctgacctcattgatgtgcatgctcagtccctggctgcgctgcaggcttactctcactggttagcacagtattgcagtgaagttcaccggcagaacacgcagcagttcgtgacactcatctctactaccatggatgcaatcacacctctaatcagcaccaagtccagaaagctgtgatatcggtggcattatggttctggcaccacgtggcggtttggtcagtcggggcaagttcca

SEQ ID NO: 345689 - DNA, 2203 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagctatatcgagaagtttactgactttcttcggctctttgtgagtgttcacctaagaagaatcgagtcttactcccagttccctgtggtggagtttttgacacttttgttcaagtacacatttcatcagcctactcatgaaggttacttctcttgtttggatatctggacgctgtttttggactatctgacaagtaaaattaaaagtcgtcttggagacaaggaagcagttctcaacaggtacgaagatgccctggtgctcctgctcacagaggtgttgaatcgaatccagttcagatacaaccaagcccagctggaggagttggatgatgagactctggatgacgatcagcagacggagtggcagcggtacttacggcagagcttggaggtggtggccaaagtgatggagctcctgcccacgcacgccttctccacactgttccctgttcttcaggacaatttagaagtttatttgggattcgacgataaatgtcaacaccagggtcaggaaacgaatgattacaggtacagagctgattc

SEQ ID NO: 345690 - DNA, 1741 bp, Homo sapiens
gcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggcatctgaagaagcctctctcagggcattggaaagtctgatgacagaattttttcacgattgtacaaccaatgaaagaaaacgtgagatagaggagcttcttaataactttgcccagcaaataggagcctggagattctgcctgtactttctctccagcactaggaatgactatgtaatgatgtacagtttaacagtttttgagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtatcttggagactgtctgggacaaacacagtgttactgctgccactccaccaccatccccgacctcaggagaaagtggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagagaatatggggctcctggtgaggaacagaaaggtaggtgtgtgccagtaagtctgagattagctggaagggcttgggtgg

SEQ ID NO: 345691 - DNA, 691 bp, Homo sapiens
ggcctctcactgattgattgtgttgagagtgttagcaattagaacttctaaaatggatttgcacaaataaaatttcaattttctcttttacttactggtttataaaatgttgctttgtttaaaatgaagttgttgactgctttaaaaagtttgataaccactgagcgaaagtaattatattcaaattatggagtttcaaacatttgccagaagctaagggagcagctggactttctgcttgaaacctcattaataggtgactgtctaccctgcatatggatacaactgtccaggtacccatcatgcaaaagtttatttaaaaactaattaacatattatattgtccagacagttttcagtgatttcattcacatttaacaatgatactcttttcttcgggcagaatttcccaaaacccagcaaggactccactgatggaaaatgagatgggttagtgggtacatggatgaatgttttaaaagtttaatggttttatatttactattacagttgtcttctctttgtggtaagaaatgctgaattttttactatcatttataatgttaatcaaaattttcttttaaaaattaattcaagtaaaaatagagtaaaacatcctacctaagtgataatttagaagatacttagatgttgccaaaattgtgaaggtgaagccagaaagactaaagtt

SEQ ID NO: 345692 - DNA, 755 bp, Homo sapiens
cccgtggcatttctgagtcacatatttccagcatgcctagtgcatggtcagacactgtgttaggtgctttttcattgatccacacagccgttgggagggaaggatgaaaaccaacattctacagataaggcaacaggagctctgcagggttgtaccatacacccaaggtcacttagctaagaaggaacactggggatttggacccaggtcctcttctctttaccccacccagtacttcagtcaactcaatcatcatcacaaccatgcctgtccctcacctcaattcatacatccttggtagagtcaccatgaattcagctttgctctggcatgaagatattccatactaggcaactgaattgaatttgtgattaaaatggaaacttactagaaatctcatcagggagagtgctctgagttttcttagattcttatatttgtccatttggcattcattcatcacagggccaattgtattaactgattttttatattctaaggagcatgcctttcatatgctaactaaccaatccagagctgcaaacatctcctttattaaataaactctcacaccccagatcaatattttccctgctctaaatcaacccagggctacgtaccagacaacccagagttcttcaaatcagccagtcctaaactgttcgccatcttgccatgcctttcccacagaaaaacacaataaaggctctgatctaagctttccccacatgccctctgcttctaaccaactgacc

SEQ ID NO: 345693 - DNA, 398 bp, Homo sapiens
tgttcggatggcacaagtcaccacctctagaagcaaaaacttcaacctcctgtgtatctgaggcacctcgccctgactggtaaagcaaagaaactggataggagaaggcctgtgttgagggcatcaatggctaactgtcagcagggacaacagccattatcccatatccagtgagtacaacagacttgctgcagttttacatccagttcactgatcaactatcaaactgaaggatagcttgtcactgcatctgcagtgactcacttgccttggggaaaaatacatgtcacacatttacattttggcttttaagtgaggaaacttcatggttttcagaacagagtaagattcttgaaaactaaaacaataaatccaatgctgattgtgaaaaatgatga

SEQ ID NO: 345694 - DNA, 463 bp, Homo sapiens
tgttcggatggcacaagtcaccacctctagaagcaaaaacttcaacctcctgtgtatctgaggcacctcgccctgactggtaaagcaaagaaactggataggagaaggcctgtgttgagggcatcaatggctaactgtcagcagggacaacagccattatcccatatccagtgagtacaacagcatgaagtcttgctaccttgccagatgctatcaccatgcccttggacttcccaacctccaggattacttgctgcagttttacatccagttcactgatcaactatcaaactgaaggatagcttgtcactgcatctgcagtgactcacttgccttggggaaaaatacatgtcacacatttacattttggcttttaagtgaggaaacttcatggttttcagaacagagtaagattcttgaaaactaaaacaataaatccaatgctgattgtgaaaaatgatga

SEQ ID NO: 345695 - DNA, 568 bp, Homo sapiens
aatttataaagaaaggaagtttaattggctcatggttctgcagggtgtacaggaagcatggtgctggcatctgcttctggtaagggttcaggaagcttacaatcatagtggaagatgaaggggtagtatgcacatcacatggtgagagcaggagcaagagagggaggtgagagatgccacacactgttaaacaaccagatctctcatgaactcactcatcaccaaggggatgtcactaaaccattcataaaccattcatgagggatatgcccccaatgatccaagcacctcccaccaggtcccaccttcaacactggggttacatttcaacatgagatttggaggagacaaatatccaaattttatcagcgtttttagtgaattccttaggattttctatatataagatcatgacatctgcaatagaggtagttttagtcttcctttccaatctgtgaatgcctgttacttattttccttgcctagttgccatggctagaacctctagtatcatgtcaaatatcagtgatgagtgcagatccttgtcttgttcctaatcttagggaga

SEQ ID NO: 345696 - DNA, 513 bp, Homo sapiens
aatttataaagaaaggaagtttaattggctcatggttctgcagggtgtacaggaagcatggtgctggcatctgcttctggtaagggttcaggaagcttacaatcatagtggaagatgaaggggtagtatgcacatcacatggtgagagcaggagcaagagagggaggtgagagatgccacacactgttaaacaaccagatctctcatgaactcactcatcaccaaggggatgtcactaaaccattcataaaccattcatgagggatatgcccccaatgatccaagcacctcccaccaggtcccaccttcaacaccgtttttagtgaattccttaggattttctatatataagatcatgacatctgcaatagaggtagttttagtcttcctttccaatctgtgaatgcctgttacttattttccttgcctagttgccatggctagaacctctagtatcatgtcaaatatcagtgatgagtgcagatccttgtcttgttcctaatcttagggaga

SEQ ID NO: 345697 - DNA, 288 bp, Homo sapiens
ggagagtaaaatagctaatgaaggattataaagcactttgctaatataaaatgcaacatcaaagctgaataataatcttaatttagggtgaagggttccattagcagagtaaaaataaaaaggacaaagggtagtgttgctttgtaccttgataacagtgtacaaatcaaaagtgctgctattgatcctcattgccctgtgaactctcaacccaggaatttggctcccctccctaactctctaagtacttcccttacccactcagtgtggtgatggcacctccctgaa

SEQ ID NO: 345698 - DNA, 421 bp, Homo sapiens
ctcccaaagtgctaggattacaggcatgagccacggtgtccggcctattgtgtaactttttaaattaaaaatgacagcataatatgtcaaacaagagataacaccttgtcatgttagtacctacatctccggcatttatttttaacagctgcatagaatactcttgcatcagtatatcatcatttaatcctgtattaatgtacacttgagggtggtttttccactaatttttcctattaaacagactgctgaaataaaaacctttggagacccaagaaaaattttacttgtaaatctgtaactgtatacacatatgtatatacgtatacacacacgtatatgtgtacatattagatgctcagttggatatggttctagaagtggaattgcaaaataaaaacatatttacaacttgcttacc

SEQ ID NO: 345699 - DNA, 4583 bp, Homo sapiens
gcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggccccggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcacttattataactggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagatatcaacattattatattttaaaatcacgctatggaaatatcacctgaattctgtcatttgtcagatttacagtacctttttttctttaacttttagcattaaataaaaataaaattgggagcactgaa

SEQ ID NO: 345700 - DNA, 4475 bp, Homo sapiens
ggctggccgctgacgctggcgctggagagcggcgacgccaggagctgtgagagagcgctcaagcgggcgcacggctgcttcccggagggtcgctccccacccggcgccgcggccccggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcacttattataactggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagatatcaacattattatattttaaaatcacgctatggaaatatcacctgaattctgtcatttgtcagatttacagtacctttttttctttaacttttagcattaaataaaaataaaattgggagcactgaa

SEQ ID NO: 345701 - DNA, 4631 bp, Homo sapiens
gcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggccccggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcaggcaggttgttgggtttcgaggccaacggggccaacgggtctaaagcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcacttattataactggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagatatcaacattattatattttaaaatcacgctatggaaatatcacctgaattctgtcatttgtcagatttacagtacctttttttctttaacttttagcattaaataaaaataaaattgggagcactgaa

SEQ ID NO: 345702 - DNA, 4487 bp, Homo sapiens
  misc_feature (4463)..(4463): n is a, c, g, or t
gcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggccccggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcacttattataactggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagatatcaaccngtgaaatcggtcccgagctgatga

SEQ ID NO: 345703 - DNA, 3947 bp, Homo sapiens
attcttggatgggagcatgagggcaccagtcaccttttaacctattgggggacattagcagtcacatgttgagtgcaaacgagggtacttttgtgcatgtgtacaaacaggcagttacaagcgtgtcattttcagtggctccattttaaatcagtctgctgcctcagaatcccgtacgcctgaaggttttaagttgcatgtgcacctgaaactcgtatatgagtattttctgtctgtgcttttagagaggaggaattctgtaacgacttttgtttcgggttaggaagagaatgatctctttcagtgcaccgccacttatgttacctttttccttttatttctttgtgtttccagtttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcacttattataactggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagatatcaacattattatattttaaaatcacgctatggaaatatcacctgaattctgtcatttgtcagatttacagtacctttttttctttaacttttagcattaaataaaaataaaattgggagcactgaa

SEQ ID NO: 345704 - DNA, 3661 bp, Homo sapiens
  misc_feature (41)..(41): n is a, c, g, or t
aagagaagaagaaagaaaagagaaaagagaaagaaagaaantcgacaaagaagacgggcctagtcgcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcacttattataactggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagatatcaacattattatattttaaaatcacgctatggaaatatcacctgaattctgtcatttgtcagatttacagtacctttttttctttaacttttagcattaaataaaaataaaattgggagcactgaa

SEQ ID NO: 345705 - DNA, 3749 bp, Homo sapiens
gcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggccccggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcaccattccgaatctttttgccaattttacctgccctattaagcattttgtattgccttaacttcatatgttcttgtttacttatattcccttctagccactttggtttctccctccccgctcgtccaactgatagcctgttttcttaattcgcgtactttatttactcaaataattaa

SEQ ID NO: 345706 - DNA, 3080 bp, Homo sapiens
gcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggccccggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattaga

SEQ ID NO: 345707 - DNA, 2097 bp, Homo sapiens
gcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggccccggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaa

SEQ ID NO: 345708 - DNA, 2130 bp, Homo sapiens
  misc_feature (2122)..(2122): n is a, c, g, or t
gcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggccccggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaaaaccaaaaccgaagaaaaacaaaanaaccttgt

SEQ ID NO: 345709 - DNA, 1995 bp, Homo sapiens
  misc_feature (1979)..(1979): n is a, c, g, or t
  misc_feature (1984)..(1984): n is a, c, g, or t
  misc_feature (1986)..(1986): n is a, c, g, or t
gcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggccccggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctgatttgccaagtgctctaaaaaagcagcgcaagtcacagcctacatagaacggtaantgtcncncaggataat

SEQ ID NO: 345710 - DNA, 1602 bp, Homo sapiens
gcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggccccggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggatgtttacccaatcaagctacgttgtacacgtag

SEQ ID NO: 345711 - DNA, 4905 bp, Homo sapiens
gcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggccccggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcacttattataactggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagatatcaacattattatattttaaaatcacgctatggaaatatcacctgaattctgtcatttgtcagatttacagtacctttttttctttaacttttagcattaaataaaaataaaattgggagcactgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgagctccattggcccaaagtaatttaaaattagaaaattttttctgtgcggccccaatttgggctctattgggaaaatcccccttatgggggggattttaaaatttaatgggcctgtttttaaaaagttggggatggggaaaaccctggggttcccaaaataaaactcttttggcaatccctttttcccagggggcatttatggccc

SEQ ID NO: 345712 - DNA, 4415 bp, Homo sapiens
  misc_feature (4195)..(4195): n is a, c, g, or t
gcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggccccggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcacttattataactggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatagggngggggtggaaggttccttttgggtttaacattttgaatttaggaagtgtgtgtagggggccattaggttggaacacacgggttacttatatatttggtgcattaaggggtactttaggaggggtttaatagaacggggagggcaaatatataagaggaaacaggtgggaaagttttgtaagaaaaaaggcttggtgtgggtggaatagtgttgggggatt

SEQ ID NO: 345713 - DNA, 4297 bp, Homo sapiens
gcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggccccggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgactgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcaggcaggttgttgggtttcgaggccaacggggccaacgggtctaaagcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcacttattataactggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagatatcaacattattatattttaaaatcacgctatggaaatatcacctgaattctgtcatttgtcagatttacagtacctttttttctttaacttttagcattaaataaaaataaaattgggagcactgaa

SEQ ID NO: 345714 - DNA, 4545 bp, Homo sapiens
gcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggccccggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcaggcaggttgttgggtttcgaggccaacggggccaacgggtctaaagcagtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcacttattataactggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagatatcaacattattatattttaaaatcacgctatggaaatatcacctgaattctgtcatttgtcagatttacagtacctttttttctttaacttttagcattaaataaaaataaaattgggagcactgaa

SEQ ID NO: 345715 - DNA, 3765 bp, Homo sapiens
attcttggatgggagcatgagggcaccagtcaccttttaacctattgggggacattagcagtcacatgttgagtgcaaacgagggtacttttgtgcatgtgtacaaacaggcagttacaagcgtgtcattttcagtggctccattttaaatcagtctgctgcctcagaatcccttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcacttattataactggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagatatcaacattattatattttaaaatcacgctatggaaatatcacctgaattctgtcatttgtcagatttacagtacctttttttctttaacttttagcattaaataaaaataaaattgggagcactgaa

SEQ ID NO: 345716 - DNA, 3442 bp, Homo sapiens
gcggtggcggtggcggccgcgtcccggcggcagtcgtgctacctgtgtgacctgccccgcatgcccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcacttattataactggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagatatcaacattattatattttaaaatcacgctatggaaatatcacctgaattctgtcatttgtcagatttacagtacctttttttctttaacttttagcattaaataaaaataaaattgggagcactgaa

SEQ ID NO: 345717 - DNA, 2220 bp, Homo sapiens
gcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggccccggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaatgtctttataagtacataccttttgttaaccgttattagcatatctttgtgctttattatcctggtgacagttaccgttctatgtaggctgtgacttgcgctgcttttttagagcacttgggcaaatcagaaatgcttctagctgtatttg

SEQ ID NO: 345718 - DNA, 1804 bp, Homo sapiens
gcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggccccggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaacaaaaaaaaaacctcgagactagttctctctctactctcccagccttacgggcccgaaccctcgttgttgacgggtgcagacctaagccggagcggggtacaggcggccggcc

SEQ ID NO: 345719 - DNA, 1240 bp, Homo sapiens
gcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggccccggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcaggcaggttgttgggtttcgaggccaacggggccaacgggtctaaagcaggtaggggcggctgtgaagtgagggggtctaggggagaaaaggggacggagagcagaggaagggtggttctttggattcaccattttaccccagcccagaaacaacaaacaccccacttcctgatctgcctgaggcggaaccagtgcttggtggcaacgtgttcatgtctgaagcagcataacagagatgagtcagactggg

SEQ ID NO: 345720 - DNA, 666 bp, Homo sapiens
aaacaaggacacagcacccatggataacaccttcttaatggtcaaaccaaatggtcctggttttactgggggcggatttcctctcaggtcaaccaaaatgacgttctaacctgaagctgctggctgtttccagttgaacaactcatgaaatctgctctgggacattttgggggaatctcaaagtccttggatcatagaactgagtgctgagaatccaggatggaaagaaatgcagaactatcatagtcacatacatataagagggatggtgttttgtctggttcacgttgatattaacagatcataattctctctgttcagttaggctgacctattgcatgaagcaaatcttttgttgctaccccattgattgaaatgtactagaccttaatttctttattacagacattggtgtacttgaaggttttatatttaaaagtatttttgaaatgcaatgtgtcccctctcaccttattaacaataatctattttaattattcctcattaacaagtcattgcatgagatgagaaagaaggacaaactcttaagaatttaaaaagtgttttgagaatgatttctatatggaatttcttttcaggcccggaatgggaaaatctattccaaagagacacactaataaatacttcattataaaaaataaaaaa

SEQ ID NO: 345721 - DNA, 998 bp, Homo sapiens
gtttcctgctgaggcctcagtggaagtcgtcatcagtgatgctttaggggtctagtgacaccaatgaccgtgatctcagtggaaaagggcacagtgtgtcccaggcatttcgcgtttatgttaaaacgggtggaagatagcaagccggcagaggccgggccgctgcacccgcctgttccgaggtgggtagggggtggggggctgttcccaggattcccctctacgctttctgtggtgaccacggattactgcgtgacaacgggaagccgggagccgaggcccggtccctgaccacgcgtgcctggccacccctgcaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 345722 - DNA, 727 bp, Homo sapiens
tggtagcgtgcccgagggacacaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 345723 - DNA, 573 bp, Homo sapiens
gtgctaccttcaggctgattgcaggcgacagcgatttctaggtagtcagtagaattagaattgtgaagatgataagtgtacagggaaggttaatggttgatattgctagggcggcgcttccaattaggtgcatgagtaggtggcctgcaatcattccaggcttgattgaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggcaatcagcctggaagggaccgac

SEQ ID NO: 345724 - DNA, 1354 bp, Homo sapiens
ccattgtgctggaaaggcgcgcaacggcggcgacggcggcgaccccaccgcgcatcctgccaggcctccggcgcccagcggcccacgcgcccccgccgccgcccgcgccgccatgggagtggagggctgcaccaagtgcatcaagtacctgctcttcgtcttcaatttcgtcttctggctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 345725 - DNA, 1209 bp, Homo sapiens
ggtgggagcaggtggcagagaggcttcccacagctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 345726 - DNA, 1452 bp, Homo sapiens
tgattacccagaggcgcacccgtgccgtggcctgcccgtcgtctatgcacccgtgctgtggcgtgcccgtcgtctgtgtggcatgcctgtctgtgcacccgtgctgtggcgtgcccgtcgtctgtgtggcatgcctgtctgtgcacccgtgcgtggcgtgcccgtcgtctgtgcacccgtgctgtggtgtgcccttcgtctgttccttttattgccgggcagggttgcacccacatgtgcaagccagcgacggaccccaggttcacccgttcaccgctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 345727 - DNA, 1227 bp, Homo sapiens
cagacacaggatgtccctctgccagcccctgaagccccgtcccctgacgagctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 345728 - DNA, 1309 bp, Homo sapiens
catgaggtgcccagtccccatgtggcctccttagtctccgtcctgtgtcatggaagaggtaactgaggcacagaaaactcaccaggccaggctgggatgtgaggtcccttgctgctcatccctggcagtcagcaaccctacatcttcccagctgggcggcccgtggtgggttcggcacccaggaccctccggggtcttgggctgtggcgagtgtgtaggcacccacctggtgtctctctccccgcaaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 345729 - DNA, 949 bp, Homo sapiens
cggacgcgtgggtcgacccacgcgtcgggccgcggatctggggcttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 345730 - DNA, 1737 bp, Homo sapiens
  misc_feature (1559)..(1559): n is a, c, g, or t
  misc_feature (1562)..(1562): n is a, c, g, or t
ccattgtgctggaaaggcgcgcaacggcggcgacggcggcgaccccaccgcgcatcctgccaggcctccggcgcccagcggcccacgcgcccccgcgtccccgcgccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctggctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgctaaaaaaaaaaaaaaaaaaaaaaaaaaaaaaaaaaaaaaaaaaaaaaaaaaaaaaaaaaaaaggggggggggcgcgnaanaaagaaactcaccaccaagcgaggggacccccacaatatgacacgagcacaacacaggcaatatagtcaggacaaaacaaggggcgcacccaaaaaaaagagggcgcagcaataaaaagcaacgaatacgaagaagcgaccacgctgtaaaaaaaacgacgaccgcggcaggaac
